United States Patent 12,569,549 (FLAVIVIRUS VACCINE) - sequence listing, part 28

SEQ ID NO: 11493 - RNA, 9879 nt, synthetic construct
  misc_feature 1..9879: note = derived and/or modified CDS sequence (opt2) from DENV-1__KC692496__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcctcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11494 - RNA, 9879 nt, synthetic construct
  misc_feature 1..9879: note = derived and/or modified CDS sequence (opt2) from DENV-1__KC692497__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcaccggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacgtcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11495 - RNA, 9879 nt, synthetic construct
  misc_feature 1..9879: note = derived and/or modified CDS sequence (opt2) from DENV-1__KC692498__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcaccggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttctccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacgtcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11496 - RNA, 9879 nt, synthetic construct
  misc_feature 1..9879: note = derived and/or modified CDS sequence (opt2) from DENV-1__KC692499__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgtcaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagtacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcgccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11497 - RNA, 9879 nt, synthetic construct
  misc_feature 1..9879: note = derived and/or modified CDS sequence (opt2) from DENV-1__KC692500__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaagggcaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttcaagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11498 - RNA, 9879 nt, synthetic construct
  misc_feature 1..9879: note = derived and/or modified CDS sequence (opt2) from DENV-1__KC692501__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgaggagaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11499 - RNA, 9879 nt, synthetic construct
  misc_feature 1..9879: note = derived and/or modified CDS sequence (opt2) from DENV-1__KC692502__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtccgcaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgagatggagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccatgtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatctcccaggtccgccgcctcatcggcaacgagaactacctcgactacatgacctccatgaagcgcttcaagaacgagtccgaccccgagggcgccctctggtga

SEQ ID NO: 11500 - RNA, 9879 nt, synthetic construct
  misc_feature 1..9879: note = derived and/or modified CDS sequence (opt2) from DENV-1__KC692503__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggaccgcctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgatcggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgaggagaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11501 - RNA, 9879 nt, synthetic construct
  misc_feature 1..9879: note = derived and/or modified CDS sequence (opt2) from DENV-1__KC692504__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcatgaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacgtcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11502 - RNA, 9879 nt, synthetic construct
  misc_feature 1..9879: note = derived and/or modified CDS sequence (opt2) from DENV-1__KC692508__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggagcacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11503 - RNA, 9879 nt, synthetic construct
  misc_feature 1..9879: note = derived and/or modified CDS sequence (opt2) from DENV-1__KC692509__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtccgcaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgagatggagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatctcccaggtccgccgcctcatcggcaacgagaactacctcgactacatgacctccatgaagcgcttcaagaacgagtccgaccccgagggcgccctctggtga

SEQ ID NO: 11504 - RNA, 9879 nt, synthetic construct
  misc_feature 1..9879: note = derived and/or modified CDS sequence (opt2) from DENV-1__KC692510__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11505 - RNA, 9879 nt, synthetic construct
  misc_feature 1..9879: note = derived and/or modified CDS sequence (opt2) from DENV-1__KC692511__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagaactgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacatcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccaacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11506 - RNA, 9879 nt, synthetic construct
  misc_feature 1..9879: note = derived and/or modified CDS sequence (opt2) from DENV-1__KC692512__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgaggagaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcactccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcaccgctccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11507 - RNA, 9879 nt, synthetic construct
  misc_feature 1..9879: note = derived and/or modified CDS sequence (opt2) from DENV-1__KC692513__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccaccccccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacatcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggctccgagaactacctcgactacatgacctccatgaagcgcttcaagaacgagtccgaccccgagggcgccctctggtga

SEQ ID NO: 11508 - RNA, 9879 nt, synthetic construct
  misc_feature 1..9879: note = derived and/or modified CDS sequence (opt2) from DENV-1__KC692514__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11509 - RNA, 9879 nt, synthetic construct
  misc_feature 1..9879: note = derived and/or modified CDS sequence (opt2) from DENV-1__KC692515__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcggcaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgaggagaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcactccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcaccgctccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11510 - RNA, 9879 nt, synthetic construct
  misc_feature 1..9879: note = derived and/or modified CDS sequence (opt2) from DENV-1__KC692516__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgacaacttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccctcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctgcgtcaagaaggacctcatctcctacggcggcggctggcgcttccagggcctctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcccgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaagcagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11511 - RNA, 9879 nt, synthetic construct
  misc_feature 1..9879: note = derived and/or modified CDS sequence (opt2) from DENV-1__KC692517__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccatcgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccaccccccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagtccgtcaacatcgagaccgagccccccttcggcgagtcctacatcgtcgtcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaaccccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccaaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcgtccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11512 - RNA, 9879 nt, synthetic construct
  misc_feature 1..9879: note = derived and/or modified CDS sequence (opt2) from DENV-1__KC762649__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcgcctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtctccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcatcttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11513 - RNA, 9879 nt, synthetic construct
  misc_feature 1..9879: note = derived and/or modified CDS sequence (opt2) from DENV-1__KC762625__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtctccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagtcctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11514 - RNA, 9879 nt, synthetic construct
  misc_feature 1..9879: note = derived and/or modified CDS sequence (opt2) from DENV-1__KC762635__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11515 - RNA, 9879 nt, synthetic construct
  misc_feature 1..9879: note = derived and/or modified CDS sequence (opt2) from DENV-1__KC762650__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatcgaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11516 - RNA, 9879 nt, synthetic construct
  misc_feature 1..9879: note = derived and/or modified CDS sequence (opt2) from DENV-1__KC762623__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtctccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagtcctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcctctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11517 - RNA, 9879 nt, synthetic construct
  misc_feature 1..9879: note = derived and/or modified CDS sequence (opt2) from DENV-1__KC762632__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatgcagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacatcaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgaccagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11518 - RNA, 9879 nt, synthetic construct
  misc_feature 1..9879: note = derived and/or modified CDS sequence (opt2) from DENV-1__KC762637__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11519 - RNA, 9879 nt, synthetic construct
  misc_feature 1..9879: note = derived and/or modified CDS sequence (opt2) from DENV-1__KC762620__SS-prME
  source 1..9879: mol_type = other RNA
tccgtcaccatgctcttcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccatcgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagcgcggcgtcatccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgcaacacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacaaccagcgcgcctggaacatctgggaggtcgaggactacggcttcggcgtcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgagcgcgcctccttcatcgaggtcaagacctgcatctggccccgctcccacaccctctggtccaacggcgtcctcgagtccgagatgatcatccccaagacctacggcggccccgtctcccagcacaactaccgccccggctacttcacccagaccgccggcccctggcacctcggcaagctcgagctcgacttcgacctctgcgagggcaccaccgtcgtcgtcgacgagaactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtccggcaagatgctcatgaccggcaccctcgccgtcttcctcctcctcaccatgggccagctcacctggaacgacctcatccgcctctgcatcatggtcggcgccaacgcctccgacatgatgggcatgggcaccacctacctcgccctcatggccaccttccgcatgcgccccatgttcgccgtcggcctcctcttccgccgcctcacctcccgcgaggtcctcctcctcaccgtcggcctctccctcgccgcctccgtcgagctccccaactccctcgaggagctcggcgacggcctcgccatgggcatcatgatgctcaagctcctcaccgacttccagtcccaccagctctgggccaccctcctctccctcaccttcgtcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgctcctcatcaccgagaacaagatctggggccgccgctcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggacgaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcctccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaactccaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacctctacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcatcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11520 - RNA, 9879 nt, synthetic construct
  misc_feature 1..9879: note = derived and/or modified CDS sequence (opt2) from DENV-1__KC762631__SS-prME
  source 1..9879: mol_type = other RNA
tccgtcaccatgctcctcatgctcatgcccaccgccctcgccttccacctcaccacccgcggcggcgagccccacatgaccgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacctcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaacctcggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgagaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggagctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11521 - RNA, 9879 nt, synthetic construct
  misc_feature 1..9879: note = derived and/or modified CDS sequence (opt2) from DENV-1__KC762621__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11522 - RNA, 9879 nt, synthetic construct
  misc_feature 1..9879: note = derived and/or modified CDS sequence (opt2) from DENV-1__KC762643__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatggccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcctcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcatccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaaggcccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11523 - RNA, 9879 nt, synthetic construct
  misc_feature 1..9879: note = derived and/or modified CDS sequence (opt2) from DENV-1__KC762651__SS-prME
  source 1..9879: mol_type = other RNA
tccgtcaccatgctcttcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagcgcggcgtcatccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacaaccagcgcgcctggaacatctgggaggtcgaggactacggcttcggcgtcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgagcgcgcctccttcatcgaggtcaagacctgcatctggccccgctcccacaccctctggtccaacggcgtcctcgagtccgagatgatcatccccaagacctacggcggccccgtctcccagcacaactaccgccccggctacttcacccagaccgccggcccctggcacctcggcaagctcgagctcgacttcaacctctgcgagggcaccaccgtcgtcgtcgacgagaactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtccggcaagatgctcatgaccggcaccctcgccgtcttcctcctcctcaccatgggccagctcacctggaacgacctcatccgcctctgcatcatggtcggcgccaacgcctccgacatgatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccaccctcctctccctcaccttcgtcaagaccgccttctccctccactacgcctggaagaccatggccatgatcctctccatcgtctccctcttccccctctgcctctccaccacctcccagaagaccacctggctccccgtcctcctcggctccctcggctgcaagcccctcaccatgctcctcatcaccgagaacaagatctggggccgccgctcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggacgaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcctccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccccaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacctctacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcatcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11524 - RNA, 9879 nt, synthetic construct
  misc_feature 1..9879: note = derived and/or modified CDS sequence (opt2) from DENV-1__KC762653__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctaccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcatcaccgccaaccccatcgtcaccgacaaggagaagcccgtcaacatcgaggccgagccccccttcggcgagtcctacctcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatgatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgaggtcaacggcatcctcgcccagggcaagaagatgatccgcccccagcccatggagcacaagtactcctggaagtcctggggcaaggccaaggtcatcggcgccgacgtccagaacaccaccttcatcatcgacggccccaacacccccgagtgccccgacaaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgagctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacaagatgggcatgggcaccacctacctcgccctcatggccaccttccgcatgcgccccatgctcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccgccctcctctccctcaccttcgtcaagaccaccctctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagaaggccgtcctcgacgacggcatctaccgcatcctccagcgcggcctcctcggcaagtcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatggaggccttcccccagtccaacgccgccatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcatcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcaccccctccgagctcgagacccccaacctcgccgagcgcgtcctcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11525 - RNA, 9879 nt, synthetic construct
  misc_feature 1..9879: note = derived and/or modified CDS sequence (opt2) from DENV-1__KC762640__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcatcaccgccaaccccatcgtcaccgacaaggagaagcccgtcaacatcgaggccgagccccccttcggcgagtcctacctcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgaggtcaacggcatcctcgcccagggcaagaagatgatccgcccccagcccatggagcacaagtactcctggaagtcctggggcaaggccaaggtcatcggcgccgacgtccagaacaccaccttcatcatcgacggccccaacacccccgagtgccccgacaaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgagctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacaagatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccgccctcctctccctcaccttcgtcaagaccaccctctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagaaggccgtcctcgacgacggcatctaccgcatcctccagcgcggcctcctcggcaagtcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatggaggccttcccccagtccaacgccgccatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctccgcatggtcgagccctggctccgcggcaaccagttctgcatcaaggtcctcaacccctacatgccctccgtcatcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgagatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcaccccctccgagctcgagacccccaacctcgccgagcgcgtcctcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11526 - RNA, 9879 nt, synthetic construct
  misc_feature 1..9879: note = derived and/or modified CDS sequence (opt2) from DENV-1__KC762645__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtccagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11527 - RNA, 9879 nt, synthetic construct
  misc_feature 1..9879: note = derived and/or modified CDS sequence (opt2) from DENV-1__KC762628__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcatcaccgccaaccccatcgtcaccgacaaggagaagcccgtcaacatcgaggccgagccccccttcggcgagtcctacctcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgaggtcaacggcatcctcgcccagggcaagaagatgatccgcccccagcccatggagcacaagtactcctggaagtcctggggcaaggccaaggtcatcggcgccgacgtccagaacaccaccttcatcatcgacggccccaacacccccgagtgccccgacaaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgagctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatgtccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacaagatgggcatgggcaccacccacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccgccctcctctccctcaccttcgtcaagaccaccctctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggcaagtcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatcgaggccttcccccagtccaacgccgccatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctccgcatggtcgagccctggctccgcggcaaccagttctgcatcaaggtcctcaacccctacatgccctccgtcatcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcaccccctccgagctcgagacccccaacctcgccgagcgcgtcctcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11528 - RNA, 9879 nt, synthetic construct
  misc_feature 1..9879: note = derived and/or modified CDS sequence (opt2) from DENV-1__KC762624__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11529 - RNA, 9879 nt, synthetic construct
  misc_feature 1..9879: note = derived and/or modified CDS sequence (opt2) from DENV-1__KC762644__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcgagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11530 - RNA, 9879 nt, synthetic construct
  misc_feature 1..9879: note = derived and/or modified CDS sequence (opt2) from DENV-1__KC762630__SS-prME
  source 1..9879: mol_type = other RNA
tccgtcaccgtcctcttcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccatcatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcatccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacaaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccgtctcccagcacaactaccgccccggctacttcacccagaccgccggcccctggcacctcggcaagctcgagctcgacttcgacctctgcgagggcaccaccgtcgtcgtcgacgagaactgcggcaaccgcggcccctccctccgcaccaccaccgtcaccggcaagaccatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacatgatgggcatgggcaccacctacctcgccctcatggccaccttccgcatgcgccccatgttcgccgtcggcctcctcttccgccgcctcacctcccgcgagatcctcctcctcaccgtcggcctctccctcgtcgcctccgtcgagctccccaactccctcgaggagctcggcgacggcctcgccatgggcatcatgatgctcaagctcctcaccgacttccagccccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgccgctcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggacgaggccgagcactccggcgcctcccacaacatcctcgtcgaggtccaggacgacggcaccatgaagatcaaggacgaggagcgcgacgacaccctcaccatcctcctcaaggccaccctcctcgtcatctccggcgtctaccccatgtccgtccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgagatcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggtctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccccaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctcaaggcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcatctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccggcaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcttcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11531 - RNA, 9879 nt, synthetic construct
  misc_feature 1..9879: note = derived and/or modified CDS sequence (opt2) from DENV-1__KC762641__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcaccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11532 - RNA, 9879 nt, synthetic construct
  misc_feature 1..9879: note = derived and/or modified CDS sequence (opt2) from DENV-1__KC762648__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11533 - RNA, 9879 nt, synthetic construct
  misc_feature 1..9879: note = derived and/or modified CDS sequence (opt2) from DENV-1__KC762622__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatggccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcatccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaaggcccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11534 - RNA, 9879 nt, synthetic construct
  misc_feature 1..9879: note = derived and/or modified CDS sequence (opt2) from DENV-1__KC762629__SS-prME
  source 1..9879: mol_type = other RNA
tccgtcaccatgctcctcatgctcatgcccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaagaccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcggcaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11535 - RNA, 9879 nt, synthetic construct
  misc_feature 1..9879: note = derived and/or modified CDS sequence (opt2) from DENV-1__KC762627__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatgatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacctccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11536 - RNA, 9879 nt, synthetic construct
  misc_feature 1..9879: note = derived and/or modified CDS sequence (opt2) from DENV-1__KC762647__SS-prME
  source 1..9879: mol_type = other RNA
tccgtcaccatgctcctcatgctcacccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactcccgcgccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagcccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11537 - RNA, 9879 nt, synthetic construct
  misc_feature 1..9879: note = derived and/or modified CDS sequence (opt2) from DENV-1__KC762639__SS-prME
  source 1..9879: mol_type = other RNA
tccgtcaccatgctcctcatgctcacccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactcccgcgccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11538 - RNA, 9879 nt, synthetic construct
  misc_feature 1..9879: note = derived and/or modified CDS sequence (opt2) from DENV-1__KC762642__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccaccacccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatcaccggcaccctcgccgtcttcttcctcctcatcatgggccaggtcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccgtcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctctactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11539 - RNA, 9879 nt, synthetic construct
  misc_feature 1..9879: note = derived and/or modified CDS sequence (opt2) from DENV-1__JQ915077__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccatcctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcaccgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11540 - RNA, 9879 nt, synthetic construct
  misc_feature 1..9879: note = derived and/or modified CDS sequence (opt2) from DENV-1__JQ915079__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggaccaccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagcgccccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacatgggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacaccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtcccagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggaggacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11541 - RNA, 9879 nt, synthetic construct
  misc_feature 1..9879: note = derived and/or modified CDS sequence (opt2) from DENV-1__JQ915080__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggaccaccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagcgccccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacatgggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacaccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtcccagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggaggacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11542 - RNA, 9879 nt, synthetic construct
  misc_feature 1..9879: note = derived and/or modified CDS sequence (opt2) from DENV-1__KJ755855__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgagctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcgagctcttcggcaagggctccctcctcacctgcgccaagttcaagtgcgtcaccaagctcgagggcaagatcgtccagtacgagaacctcaagtactccgtcatcgtcaccgtccacatcgccgcccagcaccaggtcggcaacgagtccaccgagcacggcaccaccgccatcatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcctcttcctcctcgtcaccttcaagaccgcccacgccaagaagcaggaggtcgtcgtcctcggctcccaggagggcgccatgcacaccgccctcaccggcgccaccgccctccagaccttcggcaccaccaccatcttcgccggccacctcaacatccgcctcaagatggacaagctcaccctcaagggcatgtcctacgtcatgtgcaccggctccttcaagctcgagaaggaggtcgccgagacccagcacggcaccatcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacctcaagttcaccgtcgtcgtcggcgacgtcgccggcatcctcgcccagggcaagaagatgatccgcccccagcccatggagcacaagtactcctggaagaactggggcaaggccaagatcatcggcgccgacgtccagaactccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactactcccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgtctccctctccctcggcctcctctgcatctccatcatgatcgaggaggtcatgcgctcccgctggtcccgcaagatgctcatgaccggcaccctcgccgtcttcttccgcaagatccgcggccagctcacctggaacgacctcatccgcctctgcatcatggtcggcgccaacgcctccgaccgcatgggcacccgcaccacctacctcgccctcatggccaccttcaagatgcgccccatgttctccgtcggcctcctcttccgccgcctcacctcccgcgaggtcctcctcctcaccatcggcctctccctcgtcgcctccgtcgagctccccaactccctcgaggagctcggcgtcctcctcgccatgggcatcatgatcctcaccctcctcaccgacttccagtcccaccagctctgggccaccctcctctccatgaccttcatcaagaccaccttctccctccactacacctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagaaggccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctggggccgcgtcaagaaggacctcatctcctacggcggcggctggggcctcaagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccacgccaaggcctcccaggagggccccctccccgagaccgaggtcgaggccttccgcaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccctcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccccgccgaccgcgtcatcgacccccgccgctgcctcaaccccgtcatcctcaaggacggccccgagcgcgtcatcctcgccggccccatgcccgtcaccgtcgcctccgccaaccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagaagaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaaggccggcaacggcctcctctgcgtcatggcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatccgcctcctcttcatgatcctcaccgtcgccgccaacgagatgggcctcctcgagaccaccaagaaggacctcggcatcggccacgccgccgtcgagaaccaccaccacgccgccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggcttcctctcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctctcccccctctgggagggctcccccggcaagtcctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagaccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtctccgaggtccgcggctacaccaagggcggccccggccacgaggagcccatccccatggccacctacggctgggacctcctcaagcgctgctccggcaaggagttcttcttcatcccccccgagaagtgcgactccttcctcggcgacatcggcgagtcctcccccaaccccaccatcgaggagggccgcaccgtccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcgtcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11543 - RNA, 9879 nt, synthetic construct
  misc_feature 1..9879: note = derived and/or modified CDS sequence (opt2) from DENV-1__KF289073__SS-prME
  source 1..9879: mol_type = other RNA
tccgtcaccatgctcttcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaagaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcgtcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccaccgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacatgggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcaagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaaggccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccaccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcatgggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11544 - RNA, 9879 nt, synthetic construct
  misc_feature 1..9879: note = derived and/or modified CDS sequence (opt2) from DENV-1__JQ915072__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggaccaccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggccaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacatgggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacaccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggctcccgccgcggcaccggcgcccagggcgagaccctcggcgagaagtggaagcgccagctcaaccagctctccaagtccgagttcaacatctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggaggacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaagcaggtccgccgcctcatcggcaacgagaactacctcgactacatgacctccatgaagcgcttcaagaacgagtccgaccccgagggcgccctctggtga

SEQ ID NO: 11545 - RNA, 9879 nt, synthetic construct
  misc_feature 1..9879: note = derived and/or modified CDS sequence (opt2) from DENV-1__JQ915071__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgccaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggaccaccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagcgccccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctcctccgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacaccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggcccgcgagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggaggacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11546 - RNA, 9879 nt, synthetic construct
  misc_feature 1..9879: note = derived and/or modified CDS sequence (opt2) from DENV-1__JQ915073__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgcttccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggaccaccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggccaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgccgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacaccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggaggacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11547 - RNA, 9879 nt, synthetic construct
  misc_feature 1..9879: note = derived and/or modified CDS sequence (opt2) from DENV-1__JQ915075__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgccaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggaccaccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagcgccccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcatcttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctcctccgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggccaacgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacaccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatggccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggcccgcgagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggaggacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11548 - RNA, 9879 nt, synthetic construct
  misc_feature 1..9879: note = derived and/or modified CDS sequence (opt2) from DENV-1__JQ915076__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggaccaccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggccaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacaccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggaggacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11549 - RNA, 9879 nt, synthetic construct
  misc_feature 1..9879: note = derived and/or modified CDS sequence (opt2) from DENV-1__KF289072__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgccgtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 11550 - RNA, 9879 nt, synthetic construct
  misc_feature 1..9879: note = derived and/or modified CDS sequence (opt2) from DENV-1__JQ692085__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgccgtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccgtcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctcccccaacgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 11551 - RNA, 9879 nt, synthetic construct
  misc_feature 1..9879: note = derived and/or modified CDS sequence (opt2) from DENV-1__JQ917404__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggacccgcgagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11552 - RNA, 9879 nt, synthetic construct
  misc_feature 1..9879: note = derived and/or modified CDS sequence (opt2) from DENV-1__GU370048__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcaacttcaacgagatggtcctcctcaccatgaaggagaagtcctggctcgtccacaagcagtggttcctcgacctccccctcccctggacctccggcgcctccaccacccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactccccccgccgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatcaccggcaccctcgccgtcttcttcctcctcatcatgggccaggtcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagccccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctctactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11553 - RNA, 9879 nt, synthetic construct
  misc_feature 1..9879: note = derived and/or modified CDS sequence (opt2) from DENV-1__KM403627__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgagtccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11554 - RNA, 9879 nt, synthetic construct
  misc_feature 1..9879: note = derived and/or modified CDS sequence (opt2) from DENV-1__KM403584__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgaggtccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgcctacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcatgaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11555 - RNA, 9879 nt, synthetic construct
  misc_feature 1..9879: note = derived and/or modified CDS sequence (opt2) from DENV-1__KM403633__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgcgcgagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11556 - RNA, 9879 nt, synthetic construct
  misc_feature 1..9879: note = derived and/or modified CDS sequence (opt2) from DENV-1__KM403592__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcgcccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcgtccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccatgcccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11557 - RNA, 9879 nt, synthetic construct
  misc_feature 1..9879: note = derived and/or modified CDS sequence (opt2) from DENV-1__KM403593__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcgcccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11558 - RNA, 9879 nt, synthetic construct
  misc_feature 1..9879: note = derived and/or modified CDS sequence (opt2) from DENV-1__KM403603__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagaccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11559 - RNA, 9879 nt, synthetic construct
  misc_feature 1..9879: note = derived and/or modified CDS sequence (opt2) from DENV-1__KM403585__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggccgcatcgtccagtacgagaacctcaagtactccgtcatcgtcaccgtccacaccggcgaccagcaccaggtcggcaacgagaccaccgagcacggcaccatcgccaccatcaccccccaggcccccacctccgaggtccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgcctacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcgtcgaggtcgaccgctccgaggccaaggagggcatgaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11560 - RNA, 9879 nt, synthetic construct
  misc_feature 1..9879: note = derived and/or modified CDS sequence (opt2) from DENV-1__KM403595__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgaccgccgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagatcgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccatcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagaccgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11561 - RNA, 9879 nt, synthetic construct
  misc_feature 1..9879: note = derived and/or modified CDS sequence (opt2) from DENV-1__KM403604__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcagggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11562 - RNA, 9879 nt, synthetic construct
  misc_feature 1..9879: note = derived and/or modified CDS sequence (opt2) from DENV-1__KM403588__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatgggcaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacatcgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatccgcgactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcgccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11563 - RNA, 9879 nt, synthetic construct
  misc_feature 1..9879: note = derived and/or modified CDS sequence (opt2) from DENV-1__KM403605__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccatccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagaccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgaggtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11564 - RNA, 9879 nt, synthetic construct
  misc_feature 1..9879: note = derived and/or modified CDS sequence (opt2) from DENV-1__KM403606__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccaccctcgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagaccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11565 - RNA, 9879 nt, synthetic construct
  misc_feature 1..9879: note = derived and/or modified CDS sequence (opt2) from DENV-1__KM403591__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatgggcaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagaccaagcgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11566 - RNA, 9879 nt, synthetic construct
  misc_feature 1..9879: note = derived and/or modified CDS sequence (opt2) from DENV-1__KM403607__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccatccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagaccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11567 - RNA, 9879 nt, synthetic construct
  misc_feature 1..9879: note = derived and/or modified CDS sequence (opt2) from DENV-1__KM403581__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgaccgccgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagctctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccatcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11568 - RNA, 9879 nt, synthetic construct
  misc_feature 1..9879: note = derived and/or modified CDS sequence (opt2) from DENV-1__KM403597__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgaccgccgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccatcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatctgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11569 - RNA, 9879 nt, synthetic construct
  misc_feature 1..9879: note = derived and/or modified CDS sequence (opt2) from DENV-1__KM403610__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccatccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctcctccgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtccaagaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11570 - RNA, 9879 nt, synthetic construct
  misc_feature 1..9879: note = derived and/or modified CDS sequence (opt2) from DENV-1__KM403596__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgaccgccgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctctccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagatcgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccatcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagaccgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11571 - RNA, 9879 nt, synthetic construct
  misc_feature 1..9879: note = derived and/or modified CDS sequence (opt2) from DENV-1__KM403616__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcgtcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgccttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11572 - RNA, 9879 nt, synthetic construct
  misc_feature 1..9879: note = derived and/or modified CDS sequence (opt2) from DENV-1__KM403617__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcgtcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11573 - RNA, 9879 nt, synthetic construct
  misc_feature 1..9879: note = derived and/or modified CDS sequence (opt2) from DENV-1__KM403635__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccgcctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcgtcggcaacgagaactacctcgactacatgacctccatgaagcgcttcaagaacgagtccgaccccgagggcgccctctggtga

SEQ ID NO: 11574 - RNA, 9879 nt, synthetic construct
  misc_feature 1..9879: note = derived and/or modified CDS sequence (opt2) from DENV-1__KM403621__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgagtccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11575 - RNA, 9879 nt, synthetic construct
  misc_feature 1..9879: note = derived and/or modified CDS sequence (opt2) from DENV-1__KM403623__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgagtccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11576 - RNA, 9879 nt, synthetic construct
  misc_feature 1..9879: note = derived and/or modified CDS sequence (opt2) from DENV-1__KM403575__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11577 - RNA, 9879 nt, synthetic construct
  misc_feature 1..9879: note = derived and/or modified CDS sequence (opt2) from DENV-1__KM403586__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgaggtccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgcctacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcatgaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11578 - RNA, 9879 nt, synthetic construct
  misc_feature 1..9879: note = derived and/or modified CDS sequence (opt2) from DENV-1__KM403602__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccatcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctcctccgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtccaagaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11579 - RNA, 9879 nt, synthetic construct
  misc_feature 1..9879: note = derived and/or modified CDS sequence (opt2) from DENV-1__KM403582__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgaccgccgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccaccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccatcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagaccgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11580 - RNA, 9879 nt, synthetic construct
  misc_feature 1..9879: note = derived and/or modified CDS sequence (opt2) from DENV-1__KM403577__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11581 - RNA, 9879 nt, synthetic construct
  misc_feature 1..9879: note = derived and/or modified CDS sequence (opt2) from DENV-1__KM403631__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccatcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11582 - RNA, 9879 nt, synthetic construct
  misc_feature 1..9879: note = derived and/or modified CDS sequence (opt2) from DENV-1__KM403632__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttccgctgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11583 - RNA, 9879 nt, synthetic construct
  misc_feature 1..9879: note = derived and/or modified CDS sequence (opt2) from DENV-1__KM403583__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgaccgccgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccatcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11584 - RNA, 9879 nt, synthetic construct
  misc_feature 1..9879: note = derived and/or modified CDS sequence (opt2) from DENV-1__KM403579__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcggcaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgcaagctcatcggcaacgagaactacctcgactacatgacctccatgaagcgcttcaagaacgagtccgaccccgagggcgccctctggtga

SEQ ID NO: 11585 - RNA, 9879 nt, synthetic construct
  misc_feature 1..9879: note = derived and/or modified CDS sequence (opt2) from DENV-1__HM469968__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgccctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11586 - RNA, 9879 nt, synthetic construct
  misc_feature 1..9879: note = derived and/or modified CDS sequence (opt2) from DENV-1__KC172834__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccaggccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaacctcggccacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatcctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggggcctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11587 - RNA, 9879 nt, synthetic construct
  misc_feature 1..9879: note = derived and/or modified CDS sequence (opt2) from DENV-1__KJ933413__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccaccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccctcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttcacctcccaggacgagaagggcgtcacccagaacggccgcctcatcaccgccaaccccatcgtcaccgacaaggagaagcccgtcaacatcgaggccgagccccccttcggcgagtcctacctcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaaggtcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcacccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcggcctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccgccctcctctccctcaccttcgtcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaaccgcatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggcaagtcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatggaggccttcccccagtccaacgccgccatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagtcccaccaccacgccgccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcaccaagaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11588 - RNA, 9879 nt, synthetic construct
  misc_feature 1..9879: note = derived and/or modified CDS sequence (opt2) from DENV-1__KU666942__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccaccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgctaccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccatggagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatcgccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtgcgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgagatcatggagcccgagcacgcccagctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatgaaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11589 - RNA, 9879 nt, synthetic construct
  misc_feature 1..9879: note = derived and/or modified CDS sequence (opt2) from DENV-1__KU666939__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggtcctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgcctcccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctcctcctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11590 - RNA, 9879 nt, synthetic construct
  misc_feature 1..9879: note = derived and/or modified CDS sequence (opt2) from DENV-1__KU666940__SS-prME
  source 1..9879: mol_type = other RNA
tccgtcaccatgctcctcatgctcacccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgctaccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatcgccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtgcgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgagatcatggagcccgagcacgcccagctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatgaaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11591 - RNA, 9879 nt, synthetic construct
  misc_feature 1..9879: note = derived and/or modified CDS sequence (opt2) from DENV-1__KU666941__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcggcgccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgctaccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatcgccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtgcgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgagatcatggagcccgagcacgcccagctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatgaaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11592 - RNA, 9879 nt, synthetic construct
  misc_feature 1..9879: note = derived and/or modified CDS sequence (opt2) from DENV-1__KC172835__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcgtcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctccgcctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagaccatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatcggccagctcacctggaacgacctcatccgcctctccatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagccccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgccctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgacgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggtccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagtccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatctcccaggtccgccgcctcatcggcaacgagaactacctcgactacatgacctccatgaagcgcttcaagaacgagtccgaccccgagggcgccctctggtga

SEQ ID NO: 11593 - RNA, 9879 nt, synthetic construct
  misc_feature 1..9879: note = derived and/or modified CDS sequence (opt2) from DENV-1__EU848545__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccatcatcgccatggacctcggcgagctctgcgaggacaccatgacctacaagtgcccccgcatcaccaaggccgagcccgacgacgtcgactgctggtgcaacgccaccgacacctgggtcacctacggcacctgctcccgcaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaagcccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccaccccccaggagacctggaaccgcgaggacctcctcgtcaccttcaagaccgcccacgccaagaagcaggaggtcgtcgtcctcggctcccaggagggcgccatgcacaccgccctcaccggcgccaccgagatccagacctccggcaccaccaagatcttcgccggccacctcaagtgccgcctcaagatgaacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgctcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccgcctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcacccagggccgcaagatgatcggcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgacccccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctactccacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggacaaggaggagaacctcgtcaagtccctcgtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccgccctcctctccctcaccttcatcaagaccaccttctccctccactacgcctggaagaccgtcgccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgagatctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatctccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcggcaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgcaagtggtgcttcgacggcgagcgcaacaaccaggtcctcgaggagaacatggacgtcgagatctggaccaaggagggcgagcgcaagaagctccgcccccgctggctcgacgcccgcacctactccgacccccaggccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctgggtcgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcatcgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccatcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgacctcgagggcgccctctggtga

SEQ ID NO: 11594 - RNA, 9879 nt, synthetic construct
  misc_feature 1..9879: note = derived and/or modified CDS sequence (opt2) from DENV-1__KR024708__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgagtccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11595 - RNA, 9879 nt, synthetic construct
  misc_feature 1..9879: note = derived and/or modified CDS sequence (opt2) from DENV-1__KR024705__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacgccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11596 - RNA, 9879 nt, synthetic construct
  misc_feature 1..9879: note = derived and/or modified CDS sequence (opt2) from DENV-1__KR024706__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccggcgccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcggcggcgaggcccgcaagaccttcgtcgagctcatgaagcgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagctcgtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11597 - RNA, 9879 nt, synthetic construct
  misc_feature 1..9879: note = derived and/or modified CDS sequence (opt2) from DENV-1__KR024707__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcaccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11598 - RNA, 9879 nt, synthetic construct
  misc_feature 1..9879: note = derived and/or modified CDS sequence (opt2) from DENV-1__KC172829__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggcaccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcgtcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctccgcctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatcggccagctcacctggaacgacctcatccgcctctccatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagaccaccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttctccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgacgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggtccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagtccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatctcccaggtccgccgcctcatcggcaacgagaactacctcgactacatgacctccatgaagcgcttcaagaacgagtccgaccccgagggcgccctctggtga

SEQ ID NO: 11599 - RNA, 9879 nt, synthetic construct
  misc_feature 1..9879: note = derived and/or modified CDS sequence (opt2) from DENV-1__EU359008__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccaccacccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgccctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccaggtcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgccatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11600 - RNA, 9879 nt, synthetic construct
  misc_feature 1..9879: note = derived and/or modified CDS sequence (opt2) from DENV-1__AY835999__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagctcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgagaacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcatcctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccctcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgcccagctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11601 - RNA, 9879 nt, synthetic construct
  misc_feature 1..9879: note = derived and/or modified CDS sequence (opt2) from DENV-1__KP686070__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtctccatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11602 - RNA, 9876 nt, synthetic construct
  misc_feature 1..9876: note = derived and/or modified CDS sequence (opt2) from DENV-1__KF672760__SS-prME
  source 1..9876: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatgatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctgcgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctgg

SEQ ID NO: 11603 - RNA, 9876 nt, synthetic construct
  misc_feature 1..9876: note = derived and/or modified CDS sequence (opt2) from DENV-1__KF672759__SS-prME
  source 1..9876: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctgccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccaaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctgg

SEQ ID NO: 11604 - RNA, 9876 nt, synthetic construct
  misc_feature 1..9876: note = derived and/or modified CDS sequence (opt2) from DENV-1__KF672761__SS-prME
  source 1..9876: mol_type = other RNA
tccgtcaccatgctcttcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcggccaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctgg

SEQ ID NO: 11605 - RNA, 9876 nt, synthetic construct
  misc_feature 1..9876: note = derived and/or modified CDS sequence (opt2) from DENV-1__KF672762__SS-prME
  source 1..9876: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcatcgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcctcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggccgcaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccatcgactgggtccccacctcccgcaccacctggtccatccacgcccaccaccagtggatgaccaccgaggacatgctctccgtctggaaccgcgtctggatcgaggagaacccctggatggaggacaaggcccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctgg

SEQ ID NO: 11606 - RNA, 9879 nt, synthetic construct
  misc_feature 1..9879: note = derived and/or modified CDS sequence (opt2) from DENV-1__JF459993__SS-prME
  source 1..9879: mol_type = other RNA
tccgtcaccatgctcttcatgctcctccccacctccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctcggccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcatccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccctcgaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgcctccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgaggtcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11607 - RNA, 9876 nt, synthetic construct
  misc_feature 1..9876: note = derived and/or modified CDS sequence (opt2) from DENV-1__KF672763__SS-prME
  source 1..9876: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccgacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcatggcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccgcaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctgg

SEQ ID NO: 11608 - RNA, 9876 nt, synthetic construct
  misc_feature 1..9876: note = derived and/or modified CDS sequence (opt2) from DENV-1__KF672764__SS-prME
  source 1..9876: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgcaccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctgg

SEQ ID NO: 11609 - RNA, 9879 nt, synthetic construct
  misc_feature 1..9879: note = derived and/or modified CDS sequence (opt2) from DENV-1__EU863650__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggcctcttcaagctcgagaaggaggtcgccgagacccagcacggcaccgtcctcgtccaggtcaagtacgagggcaccgacgccccctgcaagatccccttctcctcccaggacgagaagggcgccacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtcccacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgacgagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggcacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaaggccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcacctcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaccgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaagacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctccaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactcccccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagccccccaacctcgccggccgcgtccccgactggctcgagaagcacggcaccgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11610 - RNA, 9879 nt, synthetic construct
  misc_feature 1..9879: note = derived and/or modified CDS sequence (opt2) from DENV-1__KU365900__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggccccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcctccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgcaagtggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11611 - RNA, 9879 nt, synthetic construct
  misc_feature 1..9879: note = derived and/or modified CDS sequence (opt2) from DENV-1__FJ176779__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcgtcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagaactggggcaaggccaagatcatcggcgccgacgtccagaactccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgagttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcaccaacctcgacatcatcggccagcgcatcgagaacatcaagtacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11612 - RNA, 9879 nt, synthetic construct
  misc_feature 1..9879: note = derived and/or modified CDS sequence (opt2) from DENV-1__FJ176780__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccacctccctcgaggagctcggcgacggcctcgccatgggcatcatgatcctcaagctcctcaccgacttccagtcccaccagctctgggccaccctcctctccctcaccttcgtcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggctaccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcaccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatctaccaggtccgccgcctcatcggcaacgagaactacctcgactacatgacctccatgaagcgcttcaagaacgagtccgaccccgagggcgccctctggtga

SEQ ID NO: 11613 - RNA, 9879 nt, synthetic construct
  misc_feature 1..9879: note = derived and/or modified CDS sequence (opt2) from DENV-1__JN205310__SS-prME
  source 1..9879: mol_type = other RNA
tccgtcaccgtcctcttcatgctcctccccaccgccctcgccttccacctcaccaccctcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcccctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccatcatcaccccccaggcccccacctccgagatccagctcaccgactacggcgccctcacccccgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatcccctcctcctcccaggacgagaagggcgtcatccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacaaccagcgcgcctggaacatctgggaggtcgaggactacggcttcggcatcttcaccaccaacatctggctcaagctccgcgactccttcacccaggtctgcgaccaccgcctcatgtccgccgccatcaaggactccaaggccgtccacgccgacatgggctactggatcgagtccgagaagaaggagacctggaagctcgcccgcgcctccttcatcgaggtcaagacctgcatctggcccaagtcccacaccctctggtccaacggcgtcctcgagtccgagatgatcatccccaagatctacggcggccccgtctcccagcacaactaccgccccggctacttcacccagaccgccggcccctggcacctcggcaagctcgagctcgacttcgacctctgcgagggcaccaccgtcgtcgtcgacgagaactgcggcaaccgcggcccctccctccgcaccaccaccgtcaccggcaagaccacccacgagcgctgctgccgctcctgcaccctcccccccctccgcttcaagcgcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagtccacctggaacgacctcatccgcctctgcaccatggtcggcgccaacgcctccgacatgatgggcatgggcaccacctacctcgccctcatggccaccttccgcatgcgccccatgttcgccgtcggcctcctcttccgccgcctcacctcccgcgagatcctcctcctcaccgtcggcctctccctcgtcgcctccgtcgagctccccaactccctcgaggagctcggcgacggcctcgccatgggcatcatgatgctcaagctcctcaccgacttccagccccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgccgctcctggcccctcaacgagggcatcatggccatcggcatcgtctccatcctcctctcctcccccctcaagaacgacgtccccctcgccggccccctcatcgccggcggcatgctcatcgcctgctacgtcatctccggctcctccgccgacctctccctcgagaaggccgccgaggtctcctgggaggacgaggccgagcactccggcgcctcccacaacatcctcgtcgaggtccaggacgacggcaccatgaagatcaaggacgaggagcgcgacgacaccctcaccatcctcctcaaggccaccctcctcgtcatctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctccaccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccccaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctcaaggcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccacgccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagatcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggccgccgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggccaccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcttcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccccccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11614 - RNA, 9879 nt, synthetic construct
  misc_feature 1..9879: note = derived and/or modified CDS sequence (opt2) from DENV-1__HQ332182__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgcgcatcaaggacgaggagaaggacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcgcctcccaggtcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccgtcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11615 - RNA, 9879 nt, synthetic construct
  misc_feature 1..9879: note = derived and/or modified CDS sequence (opt2) from DENV-1__HQ332181__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgtccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggcaccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccgccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 11616 - RNA, 9879 nt, synthetic construct
  misc_feature 1..9879: note = derived and/or modified CDS sequence (opt2) from DENV-1__HQ332180__SS-prME
  source 1..9879: mol_type = other RNA
tccgtcaccatgctcctcatgctcctccccaccgccctcgccttccacctcaccacccgcggcggcgagccccacatgatcatctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgccatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacccacctcgccctcatggccaccttcaagatgcgccccatgttcgccgtcggcctcctcttccgccgcctcacctcccgcgaggtcctcctcctcaccatcggcctctccctcatggcctccatggagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatgatcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11617 - RNA, 9879 nt, synthetic construct
  misc_feature 1..9879: note = derived and/or modified CDS sequence (opt2) from DENV-1__HQ332179__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctcctcctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctgcgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11618 - RNA, 9879 nt, synthetic construct
  misc_feature 1..9879: note = derived and/or modified CDS sequence (opt2) from DENV-1__KR919820__SS-prME
  source 1..9879: mol_type = other RNA
accgtcgtcgccctcctcatgctcctccccatggtcttctccttccacctcaccacccgcggcggcgagccccacatgatcgtcaacaagcaggagcgcggcaagtccctcctcttcaagacctccggcggcatcaacatgtgcaccctcatcgccatggacctcggcgacctctgcgaggacaccatgacctacaagtgcccccgcatcaccgaggccgagcccgacgacgtcgactgctggtgcaacgccaccgacacctgggtcacctacggcatctgctcccccaccggcgagcaccgccgcgagaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacatcatcggcacctccatcacccagaagggcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtctccaaccccgccgtcctccgcaagctctgcatcgaggcccgcatctccaacaccaccaccgactcccgctgccccacccagggcgaggcctccctctccgaggagcaggacaccaacttcgtctgccgccgcaccctcgtcgaccgcggctggggcaacggctgcggcctcttcggcaagggctccctcatcacctgcgccaagttcgagtgcctcaccaagatggagggcaagatcgtccagtacgagaacctcaagtactccgtcatcgtcaccgtccacaccggcgaccagcaccaggtcggcaacgagaccaccggccacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctgggcctccggcgcctcctccccccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcaagaaggaggtcgccgagacccagcacggcaccgtcctcgtccaggtcgagtacgagggcaccgacgccccctgcaagatccccttcaccacccaggacgagaagggcgtcatccagaacggccgcctcatcaccgccaaccccatcgtcaccgacaaggagaagcccgtcaacatcgaggccgagccccccttcggcgagtcctacatggtcatcggcgtcggcgacaaggccctcaagctctcctggttcaagaagggctcctccctcggcaagatgttcgaggccaccgcccgcggcgcccgccgcatggccatcctcggcgacaccgcctgggacttcggctccgtcggcggcgtcttcacctccatgggcaagctcgtccaccagatcttcggcaccgcctacggcgtcctcttctccggcgtctcctggaccatgaagatcggcatcggcctcctcctcacctggctcggcctcaactcccgctccacctccctctccatgacctgcatcgccgtcggcatcatcaccctctacctcggcgtcatggtccaggccgacaccggctgcgtcgtcaactggaagggccgcgagctcaagtgcggctccggcatcttcgtcaccaacgaggtccacacctggaccgagcagtacaagttccaggccgactcccccaagcgcctctccgccgccatcggcaaggcctgggaggacggcgtctgcggcatccgctccgccacccgcctcgagaacatcatgtggaagcagatcgccaacgagctcaactacatcctcctcgagaacgacatgaagttcaccgtcgtcgtcggcgacgtcaagggcatcctcacccagggcaagaagggcatccgcccccagcccatggagcacaagtactcctggaagtcctggggcaaggccaagatcatcggcgccgacgtccagaacaccaccttcatcatcgacggccccgacacccccgagtgccccgactcccagcgcgcctggaacatctgggaggtcgaggactacggcttcggcatcttcaccaccaacatctggctcaagctccgcgactcctacacccaggtctgcgaccaccgcctcatgtccgccgccatcaaggactcccgcgccgtccacgccgacatgggctactggatcgagtccgagaagaacgagacctggaagctctcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcagtgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcaaggtcgacaacttctccctcggcctcctctgcatctccatcatggtcgaggaggtcatgcgctcccgctggtccggcaagatgctcatgaccggcaccatggccgtcttcctcctcctcgtcatgggccagctcacctggaacgacctcatccgcgtctgcatcatggtcggcgcccacgccctcgactccatgggcatgggcaccacctacctcgccctcatggccaccttcaagatccgccccatgctcgccgtcggcctcctcttccgcaagctcacctcccgcgagatcctcctcctcaccatcggcctctccctcatcacccccgtcgagctccccaactccatcgaggagctcggcgacggcctcgccatgggcatcatgatgctcaagctcctcaccgacttccagccctaccagctctgggccaccctcctctccctcaccttcgtcaagaccaccctctccctccactacgcctggaagaccgccgccatggtcctctccatcgtctccctcctccccctctgcctctccaccacctcccagaagaccacctggctccccatcctcctcggctccctcggctgcaagcccctcaccatgttcctcatctccgagaacaagatctggggccgccgctcctggcccatcaacgagggcatcatggccgtcggcatcgtctccatcctcatgtcctccctcctcaagaacgacgtccccctcgccggccccctcatcgccggcggcatgctcgtcgcctgctacgtcatctccggctcctccgccgacctcaccctcgagaagaccgccgaggtctcctgggaggaggaggccgagcactccggcaccgcccacaacatcctcgtcgaggtccaggacgacggcaccatgaagatcaaggacgaggagcgcgaggacaccctcaccatcctcctcaaggccgccctcctcgccctctccggcgtctaccccatgtccatccccgccaccctcttcgtctggtacttctggcagaagaagaagcagcgctccggcgtcctctgggacatcccctccccccccgaggtcgagaaggccgtcctcgacgacggcatctaccgcatcctccagcgcggcgtcttcggccgctcccaggtcggcgtcggcgtcttccaggagggcgtcttccacaccatgtggcacgtcacccgcggcgccgtcctcacctaccagggcaagcgcctcgagccctcctgggcctccgtcaagaaggacctcatctcctacggcggcggctggcgcctccagggctcctggaacgtcggcgaggaggtccaggtcatcgccgtcgagcccggcaagaaccccaagaacgtccagaccgtccccggcaccttcaagacccacgagggcgaggtcggcgccatcgccctcgacttcaagcccggcacctccggctcccccatcgtcaaccgcgacggcaaggtcgtcggcctctacggcaacggcgtcgtcaccacctccggcacctacgtctccgccatcgcccagtccaaggtctcccaggagggccccctccccgagatcgaggacgaggtcttcaagaagaagaacctcaccatcatggacctccaccccggctccggcaagacccgccgctacctccccgccatcgtccgcgagtccatcaagcgccgcctccgcaccctcatcctcgcccccacccgcgtcgtcgcctccgagatggccgaggccctcaagggcctccccatccgctaccagaccaccgccgtccgcaacgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgccgaggccttcccccagtccaactccgtcatctacgacgaggagaaggacatccccgagcgctcctggaactccggctacgactggatcaccgacttccagggcaagaccgtctggttcgtcccctccatcaagaccggcaacgacatcgccaactgcctccgcaagaacggcaagcgcgtcatccagctctcccgcaagaccttcgacaccgagtaccagaagaccaagaactccgactgggacttcgtcgtcaccaccgacatctccgagatgggcgccaacttccgcgccgaccgcgtcatcgacccccgccgctgcctcaagcccgtcatcctccgcgacggccccgagcgcgtcatcctcgccggccccatgcccgtcaccgtcgcctccgccgcccagcgccgcggccgcatcggccgcaaccagtccaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcatccagtacgccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccaccacctcacccagcgcgcccagaacgccctcgacaacctcgtcatgctccacaactccgagcagggcggccgcgcctaccgccacgccatggaggagctccccgacaccatcgagaccctcatgctcctcgccatgatcgccaccctcaccggcggcgtcgccctcttcttcctctccggcaagggcctcggcaagacctccatcggcctcctctgcgtcatggcctcctccaccctcctctggatggcctccgtcgagccccactggatcgccgcctccatcgtcctcgagttcttcctcatggtcctcctcatccccgagcccgaccgccagcgcaccccccaggacaaccagctcgcctacgtcgtcatcggcctcctcgtcctcatcctcaccgtcgccgccaacgagatgggcctcctcgagaccaccaagaaggacctcggcatcggctccgccgccgccgagatccagcaccacaccaccatcctcgacgtcgacctccaccccgcctccgcctggaccctctacgccgtcgccaccaccgtcatcacccccatgctccgccacaccatcgagaacaccaccgccaacatgtccctcaccgccatcgccaaccaggccgccatcctcatgggcctcgacaagggctggcccatctccaagatggacatcggcgtccccctcctcgccctcggctgctactcccaggtcaaccccatgaccctcaccgccgccgtcctcatgctcgtcgcccactacgccatcatcggccccggcctccaggccaaggccacccgcgacgcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccttctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcaaccgccgcggcaccggcgcccagggcgagaccctcggcgagaagtggaagcgccagctcaaccagctctccaagctcgagttcaacacctacaagcgctccggcatcatggaggtcgaccgcaccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagaaggacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccaggtcatggagatcaccgccggctggctctggaagttcctctcccgcaagaagaagccccgcatctgcacccgcgaggagttcacccgcaaggtccgctccaacgccgccatcggcgccgtcttcgtcgacgagaaccagtggaactccgccaaggaggccgtcgacgacgagcgcttctgggacctcgtcaaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgacaactccctctccggcgtcgagggcgagggcctccacaagctcggctacatcctccgcgacatcgcccgcatccccggcggcaacatgtacgccgacgacaccgccggctgggacacccgcatcaccgaggaggacctccagaacgaggcccgcgtcaccgagctcatggagcccgaccacgcccagctcgccacctccatcttccgcctcacctaccagaacaaggtcgtccgcgtccagcgccccggcaagaacggcaccgtcatggacgtcatctcccgccgcgaccagcgcggctccggccaggtcggcacctacggcctcaacaccttcaccaacatggaggcccagctcatccgccagatggagtccgagggcgtcttctccccctccgagctcgagacccccaacctcgccaaccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctcccgcggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtcacctcctgggaggacgtcccctacctcggcaagcgcgaggaccagtggtgcggctccctcatcggcctctccgcccgcgccacctgggccatcaacatccaggtcgccatcaaccaggtccgcaagctcatcggcaacgagcactaccaggactacatgacctccatgcgccgcttcaagaacgagtccgagcccgagggcgccctctggtga

SEQ ID NO: 11619 - RNA, 9879 nt, synthetic construct
  misc_feature 1..9879: note = derived and/or modified CDS sequence (opt2) from DENV-1__DQ285561__SS-prME
  source 1..9879: mol_type = other RNA
tccgtcaccatgctcctcatgctcctccccaccgccctcaccttccacctcaccacccgcggcggcgagccccacatgatcgtcggcaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagatctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatgatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagtccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccggcttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatgtcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcgtcgaggtcgaccgctccgaggccaaggagggcctcaagcgcggcgagaccatcaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatgggcgcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11620 - RNA, 9879 nt, synthetic construct
  misc_feature 1..9879: note = derived and/or modified CDS sequence (opt2) from DENV-1__DQ285562__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacaccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgtcgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgactccttctccctcggcctcctctgcgtctccatcatggtcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatcgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcacctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacgtctacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacatcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaagcaggtccgccgcctcatcggcaacgagaactacctcgactacatgacctccatgaagcgcttcaagaacgagtccgaccccgagggcgccctctggtga

SEQ ID NO: 11621 - RNA, 9879 nt, synthetic construct
  misc_feature 1..9879: note = derived and/or modified CDS sequence (opt2) from DENV-1__DQ285558__SS-prME
  source 1..9879: mol_type = other RNA
tccgtcaccatgctcctcatgctcctccccaccgccctcaccttccacctcaccacccgcggcggcgagccccacatgatcgtcggcaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagtccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatgtcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcgtcgaggtcgaccgctccgaggccaaggagggcctcaagcgcggcgagaccatcaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatgggcgcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11622 - RNA, 9879 nt, synthetic construct
  misc_feature 1..9879: note = derived and/or modified CDS sequence (opt2) from DENV-1__DQ285559__SS-prME
  source 1..9879: mol_type = other RNA
tccgtcaccatgctcctcatgctcctccccaccgccctcaccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcatcgactacggcgccctcaccctcgactgctccccccgcaccggcctcgacttcaacgagatggtcctcctcaccatgaagggcaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcacccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagaagctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctccaagtggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagccccaccagctctggaccaccctcctctccctcaccttcatcaagaccaccctctccctcgactacgcctggaagaccatggccatgaccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaccgccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccaagcgcgtcctcgactggctcgagaagtacggcgccgagcgcctcaagcgcatggccatctccggcgacgactgcgtcgtcaagcccatcgacgaccgcttcgccaaggccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatggcctccatgaagcgcttcaagaacgagtccgaccccgagggcgccctctggtga

SEQ ID NO: 11623 - RNA, 9879 nt, synthetic construct
  misc_feature 1..9879: note = derived and/or modified CDS sequence (opt2) from DENV-1__AF311956__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatcctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11624 - RNA, 9879 nt, synthetic construct
  misc_feature 1..9879: note = derived and/or modified CDS sequence (opt2) from DENV-1__AF311958__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcaccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagtacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggaggagcccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcgccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11625 - RNA, 9879 nt, synthetic construct
  misc_feature 1..9879: note = derived and/or modified CDS sequence (opt2) from DENV-1__AF311957__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccaccgtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctcctccgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11626 - RNA, 9879 nt, synthetic construct
  misc_feature 1..9879: note = derived and/or modified CDS sequence (opt2) from DENV-1__EU280167__SS-prME
  source 1..9879: mol_type = other RNA
tccgtcaccatgctcctcaccctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccgtcacctacaagtgcccccgcatcaccgaggccgagcccgacgacgtcgactgctggtgcaacgccaccgacacctgggtcacctacggcacctgctcccagaccggcgagcaccgccgcgacatccgctccgtcgccctcgccccccacgtcggcctcggcctcgagacccgcaccgagacctggatgtcctccgagggcgcctggaagcagatccagcgcgtcgacacctgcgtcctccgccaccccggcttcaccgtcatcgccctcttcctcgcccacgccatcggcacctccatctcccagaagggcatcatcttcatcctcctcatgctcgtcaccccctccatgaccatgcgctgcgtcggcatcggctcccgcgacttcgtcgagggcctctccggcgccacctgggtcgacgtcgtcctcgagcacggctcctgcgtcacctccatggccaaggacaagcccaccctcgacatcgagctcctcaagaccgaggtccccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgacaagttcaagtgcgtcaccaagctcgagggcaagatcatccagtacgagaacttcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccgcgagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcggcctcaagtgcggctccggcatcttcgtcaccaacgaggtccacacctggaccggccagtacaagttccaggccgactcccccaagggcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagaactggggcaaggccaagatcatcggcgccgacgtccagaactccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctcggcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccgctcccaccagctctgggccaccctcctctccatgaccttcatcaagaccgccttctccctccactacgcctggaagaccatggccatggtcctctccatcgtctccctcttccccctctgcctctacaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtgcttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcaccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatggacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaccaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcccacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggtcgtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacaccatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgagggcgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcgagcgcgaggaccagtggtgcggctccctcatcggcctcaccgcccgcgccacctgggccaccaacgtccaggtcgccatcaaccaggtccgccgcctcatcggcaacgagaactactccgactacatgacctccatgaagcgcttcaagaacaagtccgagcccgagggcgccctctggtga

SEQ ID NO: 11627 - RNA, 9876 nt, synthetic construct
  misc_feature 1..9876: note = derived and/or modified CDS sequence (opt2) from DENV-2__AJ968413__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagctcgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaagacctggggcaaggccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccaccctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcgtcgtcctcctctcccagtccaccatccccgagaccatcctcgagctcaccgacgccctcgccctcggcatgatggtcctcaagatcgtccgcaagatggagcgctaccagctcgccgtcaccatcaccgccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgcaacggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacatccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctggggcctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11628 - RNA, 9876 nt, synthetic construct
  misc_feature 1..9876: note = derived and/or modified CDS sequence (opt2) from DENV-2__AB543624__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcatcggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccccgagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggacaaccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcgcccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaacggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcaccccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctcccccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaaccacacccacttctgcatcaaggtcctcaacccctacatgccctccgtcctcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcgcctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11629 - RNA, 9876 nt, synthetic construct
  misc_feature 1..9876: note = derived and/or modified CDS sequence (opt2) from DENV-2__AB189122__SS-prME
  source 1..9876: mol_type = other RNA
accgccggcgtcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgccccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgtcggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagaacatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccaggtctacaagaagtccggcatccaggaggtcgaccgcaccctcgccaaggagggcatcgagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11630 - RNA, 9876 nt, synthetic construct
  misc_feature 1..9876: note = derived and/or modified CDS sequence (opt2) from DENV-2__AB189123__SS-prME
  source 1..9876: mol_type = other RNA
accgccggcgtcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgccccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagaacatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactccatcgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcgagcgcggcgagaccgaccaccacgccgtctcccgcggctccgccaagctccgctgcttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaagaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcctcgacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11631 - RNA, 9876 nt, synthetic construct
  misc_feature 1..9876: note = derived and/or modified CDS sequence (opt2) from DENV-2__AB189124__SS-prME
  source 1..9876: mol_type = other RNA
accgccggcgtcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgccccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagaacatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcgagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaagaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11632 - RNA, 9876 nt, synthetic construct
  misc_feature 1..9876: note = derived and/or modified CDS sequence (opt2) from DENV-2__AB122020__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11633 - RNA, 9876 nt, synthetic construct
  misc_feature 1..9876: note = derived and/or modified CDS sequence (opt2) from DENV-2__LC121816__SS-prME
  source 1..9876: mol_type = other RNA
accgtcggcatgatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccgtcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcccacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggaggtcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagcgcgactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcctacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagcaccacaaccagaccctcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccctcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtcacccccctcctcctcacctcctcccgccagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccgacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatccgccaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagtccatccagcacctcaccgccaccgaggagatcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11634 - RNA, 9876 nt, synthetic construct
  misc_feature 1..9876: note = derived and/or modified CDS sequence (opt2) from DENV-2__LC111438__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccccccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggctccctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccatgggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcatggccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatcgtcaccaactacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcgagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11635 - RNA, 9876 nt, synthetic construct
  misc_feature 1..9876: note = derived and/or modified CDS sequence (opt2) from DENV-2__KF744400__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgacatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaagacctggggcaaggccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgccttctgcgaccccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagctcgacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctacaagggcgaggacggctgctggtacggcatggagatccgccccctcaaggagaaggaggagaacctcgtctcctccctcgtcaccgccggccacggccagatcgacaacttctccctcggcgtcctcggcatggccctcttcctcgaggagatgctccgcacccgcgtcggcatgaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaagatggagcgctaccagctcgccgtcaccatcatggccatcctctgcgtccccaactccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggaccaggccgagatctccggctcctcccccatcctctccgtcatcgtctccgaggacggctccatgtccatcaagaacgaggaggaggagcagatcctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgccatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacctgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgaggccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctctacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcacccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11636 - RNA, 9876 nt, synthetic construct
  misc_feature 1..9876: note = derived and/or modified CDS sequence (opt2) from DENV-2__KF744401__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaagacctggggcaaggccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgccttctgcgaccccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagctcgacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctacaagggcgaggacggctgctggtacggcatggagatccgccccctcaaggagaaggaggagaacctcgtctcctccctcgtcaccgccggccacggccagatcgacaacttctccctcggcgtcctcggcatggccctcttcctcgaggagatgctccgcacccgcgtcggcatgaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaagatggagcgctaccagctcgccgtcaccatcatggccatcctctgcgtccccaactccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggaccaggccgagatctccggctcctcccccatcctctccgtcatcgtctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgccatcgacctcgaccccatcccctacgaccccaagttcgagaagcagctcggccaggtcatgctcctcgtcctctgcgtcacccaggtcctcgtcatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgaggccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctctacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcacccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11637 - RNA, 9876 nt, synthetic construct
  misc_feature 1..9876: note = derived and/or modified CDS sequence (opt2) from DENV-2__KF744402__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccaccaacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcatcctcgtcggcgtcgtcaccctctacctcggcgtcgtcgtccaggccgactccggctgcgtcgtctcctggcgcaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaagacctggggccgcgccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacaccatcctcctcgtcgccgtctccttcgtcaccctcatcaccggcaacatgtccttccgcgacctcggccgcgtcatggtcatggtcggcgccaccatgaccgacaacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatcaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcatcatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccggcaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggaccacgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11638 - RNA, 9876 nt, synthetic construct
  misc_feature 1..9876: note = derived and/or modified CDS sequence (opt2) from DENV-2__KF744408__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccaccaacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcggcttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcgtcgtccaggccgactccggctgcgtcgtctcctggcgcaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctccgctactcctggaagacctggggcaaggccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcaagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggaccaggccgagatctccggctcctcccccatcctctccatcatcatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatgatcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11639 - RNA, 9876 nt, synthetic construct
  misc_feature 1..9876: note = derived and/or modified CDS sequence (opt2) from DENV-2__JX669476__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagtccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagttcccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaaggtcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacgaccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11640 - RNA, 9876 nt, synthetic construct
  misc_feature 1..9876: note = derived and/or modified CDS sequence (opt2) from DENV-2__JX475906__SS-prME
  source 1..9876: mol_type = other RNA
accgtcggcatgatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccgtcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggaggtcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccctcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccgccagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccaggccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagtccatccagcacctcaccgccaccgaggagatcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11641 - RNA, 9876 nt, synthetic construct
  misc_feature 1..9876: note = derived and/or modified CDS sequence (opt2) from DENV-2__JX669477__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacaccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcccacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttccgctccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11642 - RNA, 9876 nt, synthetic construct
  misc_feature 1..9876: note = derived and/or modified CDS sequence (opt2) from DENV-2__JX669478__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacatcgactacatgccctccatgaagcgcttccgccgcgaggaggaggaggccggcgtcctctggtga

SEQ ID NO: 11643 - RNA, 9876 nt, synthetic construct
  misc_feature 1..9876: note = derived and/or modified CDS sequence (opt2) from DENV-2__JX669480__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacaccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11644 - RNA, 9876 nt, synthetic construct
  misc_feature 1..9876: note = derived and/or modified CDS sequence (opt2) from DENV-2__JX669483__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatcaaggtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacaccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11645 - RNA, 9876 nt, synthetic construct
  misc_feature 1..9876: note = derived and/or modified CDS sequence (opt2) from DENV-2__JX669484__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacggcacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcatggtcatggtcggcgtcgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatgaccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcatcaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11646 - RNA, 9876 nt, synthetic construct
  misc_feature 1..9876: note = derived and/or modified CDS sequence (opt2) from DENV-2__JX669485__SS-prME
  source 1..9876: mol_type = other RNA
accgccggcgtcatcatcatgctcatccccaccgccatggccttccacctcaccacccgcaacggcgagccccacatgatcgtcggcaagcaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacggcacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatcgtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagctcgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11647 - RNA, 9876 nt, synthetic construct
  misc_feature 1..9876: note = derived and/or modified CDS sequence (opt2) from DENV-2__JX669486__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccacccccgagaccatcctcgagctcaccgacgccctcgccctcggcatgatggtcctcaagatcgtccgcaacatggagaagtaccagctcgccgtcaccatcatgaccatcctctgcgtccccaacgccgtcatcctcctcaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcgtcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccgtcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11648 - RNA, 9876 nt, synthetic construct
  misc_feature 1..9876: note = derived and/or modified CDS sequence (opt2) from DENV-2__JX669487__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcatgatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctccgcatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccatctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaagcacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgccgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11649 - RNA, 9876 nt, synthetic construct
  misc_feature 1..9876: note = derived and/or modified CDS sequence (opt2) from DENV-2__JX669488__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctccgcatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccatctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaagcacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgccgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11650 - RNA, 9876 nt, synthetic construct
  misc_feature 1..9876: note = derived and/or modified CDS sequence (opt2) from DENV-2__JX669479__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagtccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaaggccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11651 - RNA, 9876 nt, synthetic construct
  misc_feature 1..9876: note = derived and/or modified CDS sequence (opt2) from DENV-2__KF744403__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccaccaacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcgtcgtccaggccgactccggctgcgtcgtctcctggcgcaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaagacctggggcaaggccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcaagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaagatggagcgctaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggaccaggccgagatctccggctcctcccccatcctctccatcatcatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagatcctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatgatcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11652 - RNA, 9876 nt, synthetic construct
  misc_feature 1..9876: note = derived and/or modified CDS sequence (opt2) from DENV-2__KF744406__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccaccaacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcgtcgtccaggccgactccggctgcgtcgtctcctggcgcaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaagacctggggcaaggccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcaagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaagatggagcgctaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggaccaggccgagatctccggctcctcccccatcctctccatcatcatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagatctccctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatgatcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11653 - RNA, 9876 nt, synthetic construct
  misc_feature 1..9876: note = derived and/or modified CDS sequence (opt2) from DENV-2__KF744404__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccaccaacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcgtcgtccaggccgactccggctgcgtcgtctcctggcgcaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaagacctggggcaaggccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcaagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaagatggagcgctaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggaccaggccgagatctccggctcctcccccatcctctccatcatcatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctccagatctccctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatgatcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11654 - RNA, 9876 nt, synthetic construct
  misc_feature 1..9876: note = derived and/or modified CDS sequence (opt2) from DENV-2__KF744407__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccaccaacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgcctcctggaagaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaagacctggggcaaggccaagatcctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggagcaggccgagatctccggctcctcccccatcctctccatcatcatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatgatcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgccaccgaggagatcgccgtccagaactggctcacccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11655 - RNA, 9876 nt, synthetic construct
  misc_feature 1..9876: note = derived and/or modified CDS sequence (opt2) from DENV-2__KF744399__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccaccaacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcggcttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacgtcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaccaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctccgctactcctggaaggcctggggcaaggccaagatcctctccaccgagctccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcaagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaagatggagcgctaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggagcaggccgagatctccggctcctcccccatcctctccatcatcatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcctcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgcaacggctcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgccaccgaggagaacgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagaacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11656 - RNA, 9876 nt, synthetic construct
  misc_feature 1..9876: note = derived and/or modified CDS sequence (opt2) from DENV-2__JX286516__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcatcgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaagggcttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11657 - RNA, 9876 nt, synthetic construct
  misc_feature 1..9876: note = derived and/or modified CDS sequence (opt2) from DENV-2__JX286518__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11658 - RNA, 9876 nt, synthetic construct
  misc_feature 1..9876: note = derived and/or modified CDS sequence (opt2) from DENV-2__JX286519__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcatcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcgtcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgctccgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11659 - RNA, 9876 nt, synthetic construct
  misc_feature 1..9876: note = derived and/or modified CDS sequence (opt2) from DENV-2__KP188549__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcgagaagcgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagaccgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11660 - RNA, 9876 nt, synthetic construct
  misc_feature 1..9876: note = derived and/or modified CDS sequence (opt2) from DENV-2__KP188550__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcccacacccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggcaccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagaacatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11661 - RNA, 9876 nt, synthetic construct
  misc_feature 1..9876: note = derived and/or modified CDS sequence (opt2) from DENV-2__KP188553__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcgagaagcgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatcccctactcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagaccgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11662 - RNA, 9876 nt, synthetic construct
  misc_feature 1..9876: note = derived and/or modified CDS sequence (opt2) from DENV-2__KP188556__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcgagaagcgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccccacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagaccgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11663 - RNA, 9876 nt, synthetic construct
  misc_feature 1..9876: note = derived and/or modified CDS sequence (opt2) from DENV-2__GU369819__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccgcgccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccaggtctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11664 - RNA, 9876 nt, synthetic construct
  misc_feature 1..9876: note = derived and/or modified CDS sequence (opt2) from DENV-2__JX649147__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagtccgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaagaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctcaagaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatgtccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11665 - RNA, 9876 nt, synthetic construct
  misc_feature 1..9876: note = derived and/or modified CDS sequence (opt2) from DENV-2__KF704356__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaacaccggcgacggcgtccacatgtgcaccctcatggccatgcacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacctcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggctccatcgtcacctgcgccatgttcacctgcaagaagatcatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacgtcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgccaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgaggagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacacctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatccgcgccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccaccttcgagcccgacgtcgacctcggctccggcacccgcaacatcggcatcgagtccgagatccccaacctcgacatcatcggcaagcgcatcgagaagatcaagcaggagtacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11666 - RNA, 9876 nt, synthetic construct
  misc_feature 1..9876: note = derived and/or modified CDS sequence (opt2) from DENV-2__KF704355__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccggcgacggcgtcaacatgtgcaccctcatggccatggacctcggcgagctctgcgaggacaccatcacctacaagtgccccttcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacctcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggctccatcgtcacctgcgccatgttcacctgcaagaagatcatgaagggcaaggtcgtccagcccgagaacctcgagtacaccatcgtcatcaccccccactccggcgaggagcacgccgtcggcaacgacaccggcaagtacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacgtcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcggcaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcaccggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatccgcgccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagtacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11667 - RNA, 9876 nt, synthetic construct
  misc_feature 1..9876: note = derived and/or modified CDS sequence (opt2) from DENV-2__KF704354__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccttcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagatcatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacgtcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgccaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgaggagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacacctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggcgcctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggctggggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccaccttcgagcccgacgtcgacctcggctccggcacccgcaacatcggcatcgagtccgagatccccaacctcgacatcatcggcaagcgcatcgagaagatcaagcaggagtacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11668 - RNA, 9876 nt, synthetic construct
  misc_feature 1..9876: note = derived and/or modified CDS sequence (opt2) from DENV-2__KF704357__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccggcgacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacctcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggctccatcgtcacctgcgccatgttcacctgcaagaagatcatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacgtcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgccaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgaggagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacacctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatccgcgccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccaccttcgagcccgacgtcgacctcggctccggcacccgcaacatcggcatcgagtccgagatccccaacctcgacatcatcggcaagcgcatcgagaagatcaagcaggagtacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11669 - RNA, 9876 nt, synthetic construct
  misc_feature 1..9876: note = derived and/or modified CDS sequence (opt2) from DENV-2__KF704358__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaacaccggcgacggcgtccacatgtgcaccctcatggccatgcacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacctcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggctccatcgtcacctgcgccatgttcacctgcaagaagatcatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacgtcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgccaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcaccggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacacctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatccgcgccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccaccttcgagcccgacgtcgacctcggctccggcacccgcaacatcggcatcgagtccgagatccccaacctcgacatcatcggcaagcgcatcgagaagatcaagcaggagtacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11670 - RNA, 9876 nt, synthetic construct
  misc_feature 1..9876: note = derived and/or modified CDS sequence (opt2) from DENV-2__KF041232__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaacgccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgccaacgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttccgccgcgaggaggaggaggccggcgtcctctggtga

SEQ ID NO: 11671 - RNA, 9876 nt, synthetic construct
  misc_feature 1..9876: note = derived and/or modified CDS sequence (opt2) from DENV-2__KF041233__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgccgccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcatcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagaccctcgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttccgccgcgaggaggaggaggccggcgtcctctggtga

SEQ ID NO: 11672 - RNA, 9876 nt, synthetic construct
  misc_feature 1..9876: note = derived and/or modified CDS sequence (opt2) from DENV-2__KF041234__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaacgccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcatcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcgacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgccaacgccctcaccgccctcaacgacatgggcaaggtccgcaaggacatccagcagtgggagccctcccgcggctggtccgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttccgccgcgaggaggaggaggccggcgtcctctggtga

SEQ ID NO: 11673 - RNA, 9876 nt, synthetic construct
  misc_feature 1..9876: note = derived and/or modified CDS sequence (opt2) from DENV-2__KF041235__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttccgccgcgaggaggaggaggccggcgtcctctggtga

SEQ ID NO: 11674 - RNA, 9876 nt, synthetic construct
  misc_feature 1..9876: note = derived and/or modified CDS sequence (opt2) from DENV-2__KF041237__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccggccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttccgccgcgaggaggaggaggccggcgtcctctggtga

SEQ ID NO: 11675 - RNA, 9876 nt, synthetic construct
  misc_feature 1..9876: note = derived and/or modified CDS sequence (opt2) from DENV-2__KM217156__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaacgccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaaccccctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcatccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcttcaccgacaacgtccacacctggaccgagcagtacaagttccagcccgagtccccctccaagctcgcctccgccatccagaaggcccacgaggagggcatctgcggcatccgctccatcacccgcctcgacaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgcccagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccgcccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggcctcccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcgtctccctcctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctcctcaccggcgccgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgaccccgacgtcgacctcggctccggcacccgcaacatcggcatcgagtccgagacccccaacctcgacatcatcggcaagcgcatcgagaagatcaagcaggagcacgagacctcccgccactacgaccaggaccacccctacaagacctgggcctaccacggctcctacgagaccaagcagaccggctccgcctcctccaccgtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccgtccaggtcggcacctacggcctcggcaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcgcctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccggccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttcggccgcgaggaggaggaggccggcgtcctctggtga

SEQ ID NO: 11676 - RNA, 9876 nt, synthetic construct
  misc_feature 1..9876: note = derived and/or modified CDS sequence (opt2) from DENV-2__KX380809__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11677 - RNA, 9876 nt, synthetic construct
  misc_feature 1..9876: note = derived and/or modified CDS sequence (opt2) from DENV-2__KX380810__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccgacatcggcaccgtcatcgacctcgaccccatcccctacgaccccaagttcgagaagcagctcggccaggtcatgctcctcgtcctctgctccacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccatctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11678 - RNA, 9876 nt, synthetic construct
  misc_feature 1..9876: note = derived and/or modified CDS sequence (opt2) from DENV-2__KX380811__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaacctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11679 - RNA, 9876 nt, synthetic construct
  misc_feature 1..9876: note = derived and/or modified CDS sequence (opt2) from DENV-2__KX380813__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagtccgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcacctcccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11680 - RNA, 9876 nt, synthetic construct
  misc_feature 1..9876: note = derived and/or modified CDS sequence (opt2) from DENV-2__KX380814__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcacctcccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11681 - RNA, 9876 nt, synthetic construct
  misc_feature 1..9876: note = derived and/or modified CDS sequence (opt2) from DENV-2__KX380807__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgccccccacgtcggcatgggcctcgagacccgcaccgagacctggatgtcctccgagggcgcctggaagcacgcccagcgcatcgagatctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacaacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccgtcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagatccccgccgccctcatcgtcaccgtcatcgacctcgaccccatcccctacgaccccaagttcgagaagcagctcggccaggtcatgctcctcgtcctctgctccacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaccctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11682 - RNA, 9876 nt, synthetic construct
  misc_feature 1..9876: note = derived and/or modified CDS sequence (opt2) from DENV-2__KX380815__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctcctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccttcctcaagaacgacatccccatgaccggccccctcgtcgccggcggcctcctcaccgtctgctacgtcctcaccggccgctccgccgacctcgagctcgagcgcgccgccgacatccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagaacatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccctcatcatgaccgtcatcgacctcgaccccatcccctacgaccccaagttcgagaagcagctcggccaggtcatgctcctcgtcctctgctccacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccagctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgccaccgaggagatcgccgtcaagaactggctcgtccgcgtcggccgcgagcgcctctcccgcatggccatctccggcgacgactgcgtcgtcaagcccctcgacgaccgcttcgccaacgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11683 - RNA, 9876 nt, synthetic construct
  misc_feature 1..9876: note = derived and/or modified CDS sequence (opt2) from DENV-2__KX380816__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcacctcccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11684 - RNA, 9876 nt, synthetic construct
  misc_feature 1..9876: note = derived and/or modified CDS sequence (opt2) from DENV-2__KX380817__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11685 - RNA, 9876 nt, synthetic construct
  misc_feature 1..9876: note = derived and/or modified CDS sequence (opt2) from DENV-2__KX380818__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctcctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccttcctcaagaacgacatccccatgaccggccccctcgtcgccggcggcctcctcaccgtctgctacgtcctcaccggccgctccgccgacctcgagctcgagcgcgccgccgacatccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagaacatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccgacatcggccgcgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccagctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgccaccgaggagatcgccgtcaagaactggctcgtccgcgtcggccgcgagcgcctctcccgcatggccatctccggcgacgactgcgtcgtcaagcccctcgacgaccgcttcgccaacgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11686 - RNA, 9876 nt, synthetic construct
  misc_feature 1..9876: note = derived and/or modified CDS sequence (opt2) from DENV-2__KX380819__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcatctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccctcatcggccgcgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccatctcccgcaccacctggtccatccacgccacccacgagtggatgaccaccgaggacatgctcaccgcctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11687 - RNA, 9876 nt, synthetic construct
  misc_feature 1..9876: note = derived and/or modified CDS sequence (opt2) from DENV-2__KX380821__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11688 - RNA, 9876 nt, synthetic construct
  misc_feature 1..9876: note = derived and/or modified CDS sequence (opt2) from DENV-2__KX380822__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcaccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11689 - RNA, 9876 nt, synthetic construct
  misc_feature 1..9876: note = derived and/or modified CDS sequence (opt2) from DENV-2__KX380828__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagatgctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctacaagggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgcccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgagctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagaagaagaagctcaagccccgctggctcgacgcccgcatctactccgaccccctcgccctcaaggagttcaaggagttcgccgccggccgcaagtccctcaccatgaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgtcgcccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggccgcgccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagtccatccagcacctcaccaccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 11690 - RNA, 9876 nt, synthetic construct
  misc_feature 1..9876: note = derived and/or modified CDS sequence (opt2) from DENV-2__KX380829__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagatgctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctacaagggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgcccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgagctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagaagaagaagctcaagccccgctggctcgacgcccgcatctactccgaccccctcgccctcaaggagttcaaggagttcgccgccggccgcaagtccctcaccatgaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgtcgcccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggccgcgccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagtccatccagcacctcaccaccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 11691 - RNA, 9876 nt, synthetic construct
  misc_feature 1..9876: note = derived and/or modified CDS sequence (opt2) from DENV-2__KX380830__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccatctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11692 - RNA, 9876 nt, synthetic construct
  misc_feature 1..9876: note = derived and/or modified CDS sequence (opt2) from DENV-2__KX380831__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaacctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacaccatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11693 - RNA, 9876 nt, synthetic construct
  misc_feature 1..9876: note = derived and/or modified CDS sequence (opt2) from DENV-2__KX380808__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctcaagcagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacaccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcacccactacgccatcatcggccccggcctccaggccaaggccacccgcgaggcccagaagcgcgccgccgccggcatcatgaagatccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcctcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11694 - RNA, 9876 nt, synthetic construct
  misc_feature 1..9876: note = derived and/or modified CDS sequence (opt2) from DENV-2__KX380832__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcaccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11695 - RNA, 9876 nt, synthetic construct
  misc_feature 1..9876: note = derived and/or modified CDS sequence (opt2) from DENV-2__KX380833__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccatctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11696 - RNA, 9876 nt, synthetic construct
  misc_feature 1..9876: note = derived and/or modified CDS sequence (opt2) from DENV-2__KX380834__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaacctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11697 - RNA, 9876 nt, synthetic construct
  misc_feature 1..9876: note = derived and/or modified CDS sequence (opt2) from DENV-2__KX380835__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccatctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11698 - RNA, 9876 nt, synthetic construct
  misc_feature 1..9876: note = derived and/or modified CDS sequence (opt2) from DENV-2__KX380836__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccatctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11699 - RNA, 9876 nt, synthetic construct
  misc_feature 1..9876: note = derived and/or modified CDS sequence (opt2) from DENV-2__KX380838__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgccaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccaccctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgactccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagatccccgccgccgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccatctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11700 - RNA, 9876 nt, synthetic construct
  misc_feature 1..9876: note = derived and/or modified CDS sequence (opt2) from DENV-2__KM279515__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgccctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagacctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11701 - RNA, 9876 nt, synthetic construct
  misc_feature 1..9876: note = derived and/or modified CDS sequence (opt2) from DENV-2__KM279516__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaacatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11702 - RNA, 9876 nt, synthetic construct
  misc_feature 1..9876: note = derived and/or modified CDS sequence (opt2) from DENV-2__KM279517__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccccccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11703 - RNA, 9876 nt, synthetic construct
  misc_feature 1..9876: note = derived and/or modified CDS sequence (opt2) from DENV-2__KM279518__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccagaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11704 - RNA, 9876 nt, synthetic construct
  misc_feature 1..9876: note = derived and/or modified CDS sequence (opt2) from DENV-2__KM279519__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgccgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11705 - RNA, 9876 nt, synthetic construct
  misc_feature 1..9876: note = derived and/or modified CDS sequence (opt2) from DENV-2__KM279520__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggcccgcaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgccctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagacctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11706 - RNA, 9876 nt, synthetic construct
  misc_feature 1..9876: note = derived and/or modified CDS sequence (opt2) from DENV-2__KM279521__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactccaccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11707 - RNA, 9876 nt, synthetic construct
  misc_feature 1..9876: note = derived and/or modified CDS sequence (opt2) from DENV-2__KM279583__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggccctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11708 - RNA, 9876 nt, synthetic construct
  misc_feature 1..9876: note = derived and/or modified CDS sequence (opt2) from DENV-2__KM279585__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgacaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggaacctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11709 - RNA, 9876 nt, synthetic construct
  misc_feature 1..9876: note = derived and/or modified CDS sequence (opt2) from DENV-2__KM279525__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcatcctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaacatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11710 - RNA, 9876 nt, synthetic construct
  misc_feature 1..9876: note = derived and/or modified CDS sequence (opt2) from DENV-2__KM279528__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccaagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11711 - RNA, 9876 nt, synthetic construct
  misc_feature 1..9876: note = derived and/or modified CDS sequence (opt2) from DENV-2__KM279533__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgagaacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11712 - RNA, 9876 nt, synthetic construct
  misc_feature 1..9876: note = derived and/or modified CDS sequence (opt2) from DENV-2__KM279535__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11713 - RNA, 9876 nt, synthetic construct
  misc_feature 1..9876: note = derived and/or modified CDS sequence (opt2) from DENV-2__KM279539__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgaggagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11714 - RNA, 9876 nt, synthetic construct
  misc_feature 1..9876: note = derived and/or modified CDS sequence (opt2) from DENV-2__KM279543__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcatgttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11715 - RNA, 9876 nt, synthetic construct
  misc_feature 1..9876: note = derived and/or modified CDS sequence (opt2) from DENV-2__KM279571__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11716 - RNA, 9876 nt, synthetic construct
  misc_feature 1..9876: note = derived and/or modified CDS sequence (opt2) from DENV-2__KM279544__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcacctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcatgttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagaccctcgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11717 - RNA, 9876 nt, synthetic construct
  misc_feature 1..9876: note = derived and/or modified CDS sequence (opt2) from DENV-2__KM279549__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgtcgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11718 - RNA, 9876 nt, synthetic construct
  misc_feature 1..9876: note = derived and/or modified CDS sequence (opt2) from DENV-2__KM279552__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccactccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11719 - RNA, 9876 nt, synthetic construct
  misc_feature 1..9876: note = derived and/or modified CDS sequence (opt2) from DENV-2__KM279557__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaactccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11720 - RNA, 9876 nt, synthetic construct
  misc_feature 1..9876: note = derived and/or modified CDS sequence (opt2) from DENV-2__KM279591__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgtcgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11721 - RNA, 9876 nt, synthetic construct
  misc_feature 1..9876: note = derived and/or modified CDS sequence (opt2) from DENV-2__KM279558__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11722 - RNA, 9876 nt, synthetic construct
  misc_feature 1..9876: note = derived and/or modified CDS sequence (opt2) from DENV-2__KM279564__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcatcgaggaggaggaggccggcgtcctctggtga

SEQ ID NO: 11723 - RNA, 9876 nt, synthetic construct
  misc_feature 1..9876: note = derived and/or modified CDS sequence (opt2) from DENV-2__KM279595__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagaacatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaaggactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11724 - RNA, 9876 nt, synthetic construct
  misc_feature 1..9876: note = derived and/or modified CDS sequence (opt2) from DENV-2__KM279566__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11725 - RNA, 9876 nt, synthetic construct
  misc_feature 1..9876: note = derived and/or modified CDS sequence (opt2) from DENV-2__KM279574__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcacctcccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcgagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcacccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11726 - RNA, 9876 nt, synthetic construct
  misc_feature 1..9876: note = derived and/or modified CDS sequence (opt2) from DENV-2__KM279568__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacatcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11727 - RNA, 9876 nt, synthetic construct
  misc_feature 1..9876: note = derived and/or modified CDS sequence (opt2) from DENV-2__KM279569__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaaggactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11728 - RNA, 9876 nt, synthetic construct
  misc_feature 1..9876: note = derived and/or modified CDS sequence (opt2) from DENV-2__KM279570__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgccgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11729 - RNA, 9876 nt, synthetic construct
  misc_feature 1..9876: note = derived and/or modified CDS sequence (opt2) from DENV-2__KM279596__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgccgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11730 - RNA, 9876 nt, synthetic construct
  misc_feature 1..9876: note = derived and/or modified CDS sequence (opt2) from DENV-2__FJ850072__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgccctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatgaccatctcctgcgtccccaacgccatgatcctcctcaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctctccctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccgtcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcatgctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11731 - RNA, 9876 nt, synthetic construct
  misc_feature 1..9876: note = derived and/or modified CDS sequence (opt2) from DENV-2__JN819419__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcgtcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaacatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgcccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagatcccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctcacccgcatggccatctccggcgacgactgcgtcgtcaagcccatcgacgaccgcttcgccaacgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11732 - RNA, 9876 nt, synthetic construct
  misc_feature 1..9876: note = derived and/or modified CDS sequence (opt2) from DENV-2__FJ850074__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctccccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcgtcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgctccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctcacccgcatggccatctccggcgacgactgcgtcgtcaagcccatcgacgaccgcttcgccaacgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11733 - RNA, 9876 nt, synthetic construct
  misc_feature 1..9876: note = derived and/or modified CDS sequence (opt2) from DENV-2__FJ850076__SS-prME
  source 1..9876: mol_type = other RNA
accgccggcgccatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctccccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcgtcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacgtccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgctccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctcacccgcatggccatctccggcgacgactgcgtcgtcaagcccatcgacgaccgcttcgccaacgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11734 - RNA, 9876 nt, synthetic construct
  misc_feature 1..9876: note = derived and/or modified CDS sequence (opt2) from DENV-2__GQ868640__SS-prME
  source 1..9876: mol_type = other RNA
accgccggcgccatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctccccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatcaccgacgacatcggcatgggcgtcacctacctcgccctcctcgccgccttcaaggtccgccccaccttcgccgccggcctcctcctccgcaagctcacctccaaggagctcatgatggccaccatcggcgtcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacgtccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgctccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctcacccgcatggccatctccggcgacgactgcgtcgtcaagcccatcgacgaccgcttcgccaacgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11735 - RNA, 9876 nt, synthetic construct
  misc_feature 1..9876: note = derived and/or modified CDS sequence (opt2) from DENV-2__FJ850078__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttcaacggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctccccaccgagtcccacaaccagaccttcctcatcgacggccccgagaccgccgagtgccccaacgccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcgtcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgctccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcacccgcggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctcacccgcatggccatctccggcgacgactgcgtcgtcaagcccatcgacgaccgcttcgccaacgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11736 - RNA, 9876 nt, synthetic construct
  misc_feature 1..9876: note = derived and/or modified CDS sequence (opt2) from DENV-2__FJ850082__SS-prME
  source 1..9876: mol_type = other RNA
accgtcggcgtcatcgtcatgctcatccccaccgccatggccttccacctcaccacccgcaacggcgagccccacatgatcgtcggccgccaggagaagggcaagtccctcctcttcaagaccgagaacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccgtcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcgtcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggagggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgacaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagatcccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatgatcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctcacccgcatggccatctccggcgacgactgcgtcgtcaagcccatcgacgaccgcttcgccaacgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11737 - RNA, 9876 nt, synthetic construct
  misc_feature 1..9876: note = derived and/or modified CDS sequence (opt2) from DENV-2__FJ850085__SS-prME
  source 1..9876: mol_type = other RNA
accgtcggcgtcatcgtcatgctcatccccaccgccatggccttccacctcaccacccgcaacggcgagccccacatgatcgtcggccgccaggagaagggcaagtccctcctcttcaagaccgagaacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccgtcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcgtcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggagggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgacaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagatcccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatgatcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctcacccgcatggccatctccggcgacgactgcgtcgtcaagcccatcgacgaccgcttcgccaacgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11738 - RNA, 9876 nt, synthetic construct
  misc_feature 1..9876: note = derived and/or modified CDS sequence (opt2) from DENV-2__FJ850088__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttcaacggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctccccaccgagtcccacaaccagaccttcctcatcgacggccccgagaccgccgagtgccccaacgccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccctcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcgtcgccctcctctcccagtccaccatccccgagaccatcctcgagctcaccgacgccctcgccctcggcatgatggccctcaaggtcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgctccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcgccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccgtcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcacccgcggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcacctacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctcccgcaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctcacccgcatggccatctccggcgacgactgcgtcgtcaagcccatcgacgaccgcttcgccaacgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11739 - RNA, 9876 nt, synthetic construct
  misc_feature 1..9876: note = derived and/or modified CDS sequence (opt2) from DENV-2__FJ850091__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgcgccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgccaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11740 - RNA, 9876 nt, synthetic construct
  misc_feature 1..9876: note = derived and/or modified CDS sequence (opt2) from DENV-2__GQ199890__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccatcggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcgcgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccaccatcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggcaccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgcaaggaggaggaggaggccggcgtcctctggtga

SEQ ID NO: 11741 - RNA, 9876 nt, synthetic construct
  misc_feature 1..9876: note = derived and/or modified CDS sequence (opt2) from DENV-2__GQ868549__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatgggcaacgagggctacaccgactacatgccctccatgaagcgcttccgccgcgaggaggaggaggccggcgtcctctggtga

SEQ ID NO: 11742 - RNA, 9876 nt, synthetic construct
  misc_feature 1..9876: note = derived and/or modified CDS sequence (opt2) from DENV-2__GQ868551__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggtcaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatgggcaacgagggctacaccgactacatgccctccatgaagcgcttccgccgcgaggaggaggaggccggcgtcctctggtga

SEQ ID NO: 11743 - RNA, 9876 nt, synthetic construct
  misc_feature 1..9876: note = derived and/or modified CDS sequence (opt2) from DENV-2__HM181971__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatcgacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatgggcaacgagggctacaccgactacatgccctccatgaagcgcttccgccgcgaggaggaggaggccggcgtcctctggtga

SEQ ID NO: 11744 - RNA, 9876 nt, synthetic construct
  misc_feature 1..9876: note = derived and/or modified CDS sequence (opt2) from DENV-2__GU131881__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaagaacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11745 - RNA, 9876 nt, synthetic construct
  misc_feature 1..9876: note = derived and/or modified CDS sequence (opt2) from DENV-2__FJ898461__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttccagaccaccgtccgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgtcgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcctcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11746 - RNA, 9876 nt, synthetic construct
  misc_feature 1..9876: note = derived and/or modified CDS sequence (opt2) from DENV-2__FJ024473__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcacctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcgacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctacctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagaccaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctccccccccctcgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccgtcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgaggccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgcccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11747 - RNA, 9876 nt, synthetic construct
  misc_feature 1..9876: note = derived and/or modified CDS sequence (opt2) from DENV-2__FJ024474__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacatcggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctacctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgcctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcacccacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccgtcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgcccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11748 - RNA, 9876 nt, synthetic construct
  misc_feature 1..9876: note = derived and/or modified CDS sequence (opt2) from DENV-2__FJ024475__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcgacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctacctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagaccaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccgtcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatgaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgcccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11749 - RNA, 9867 nt, synthetic construct
  misc_feature 1..9867: note = derived and/or modified CDS sequence (opt2) from DENV-2__FJ182012__SS-prME
  source 1..9867: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctacctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcacccacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccgtcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctctccctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgcccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11750 - RNA, 9876 nt, synthetic construct
  misc_feature 1..9876: note = derived and/or modified CDS sequence (opt2) from DENV-2__EU854293__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccggcgacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagtccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacgaggtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcctcttccccgtctccatgcccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11751 - RNA, 9876 nt, synthetic construct
  misc_feature 1..9876: note = derived and/or modified CDS sequence (opt2) from DENV-2__EU854294__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctacctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccgtcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgcccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11752 - RNA, 9876 nt, synthetic construct
  misc_feature 1..9876: note = derived and/or modified CDS sequence (opt2) from DENV-2__FJ024477__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgccacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgccgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11753 - RNA, 9876 nt, synthetic construct
  misc_feature 1..9876: note = derived and/or modified CDS sequence (opt2) from DENV-2__GQ868552__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatcgccctcttcctcgaggagatgctccgcacccgcgtcggcaccaagcacgccatcctcctcgtcgccatctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgccgcctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccacgccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgagaacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctctccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11754 - RNA, 9876 nt, synthetic construct
  misc_feature 1..9876: note = derived and/or modified CDS sequence (opt2) from DENV-2__GQ868553__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcaggtcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgtcggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcttcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttccgcaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgcccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11755 - RNA, 9876 nt, synthetic construct
  misc_feature 1..9876: note = derived and/or modified CDS sequence (opt2) from DENV-2__GQ868554__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgtcgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11756 - RNA, 9876 nt, synthetic construct
  misc_feature 1..9876: note = derived and/or modified CDS sequence (opt2) from DENV-2__GQ868555__SS-prME
  source 1..9876: mol_type = other RNA
accgccggcgtcatcgtcatgctcatccccaccgccatcgccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgaggtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggagggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatcgaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11757 - RNA, 9876 nt, synthetic construct
  misc_feature 1..9876: note = derived and/or modified CDS sequence (opt2) from DENV-2__GQ868556__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11758 - RNA, 9876 nt, synthetic construct
  misc_feature 1..9876: note = derived and/or modified CDS sequence (opt2) from DENV-2__GQ868557__SS-prME
  source 1..9876: mol_type = other RNA
accgccggcgtcatcgtcatgctcatccccaccgccatcgccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgaggtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagaacgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11759 - RNA, 9876 nt, synthetic construct
  misc_feature 1..9876: note = derived and/or modified CDS sequence (opt2) from DENV-2__GU131947__SS-prME
  source 1..9876: mol_type = other RNA
accgccggcgtcatcgtcatgctcatccccaccgccatcgccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccatgatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgaggtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggccgcgccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccatcgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11760 - RNA, 9876 nt, synthetic construct
  misc_feature 1..9876: note = derived and/or modified CDS sequence (opt2) from DENV-2__GQ868558__SS-prME
  source 1..9876: mol_type = other RNA
accgccggcgtcatcgtcatgctcatccccaccgccatcgccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgcactccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgtcctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgaggtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacgccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccatcgaggagatcgccgtccagaactggctcgccaaggtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11761 - RNA, 9876 nt, synthetic construct
  misc_feature 1..9876: note = derived and/or modified CDS sequence (opt2) from DENV-2__KJ189305__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgcctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacaccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11762 - RNA, 9876 nt, synthetic construct
  misc_feature 1..9876: note = derived and/or modified CDS sequence (opt2) from DENV-2__FJ898451__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgtcctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11763 - RNA, 9876 nt, synthetic construct
  misc_feature 1..9876: note = derived and/or modified CDS sequence (opt2) from DENV-2__HM488257__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgtcaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccacctacgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccatggtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagcaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcaagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgccaccgaggagatcgccgtcaagacctggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11764 - RNA, 9876 nt, synthetic construct
  misc_feature 1..9876: note = derived and/or modified CDS sequence (opt2) from DENV-2__HQ999999__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacatccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccatcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaaggtcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaccaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcctcacccccatgctccgccactccatcgagaactcctccgtcaacgtctccctcaccgccatcgccaaccaggccaccgtcctcatgggcctcggcaagggctggcccctctccaagatggacatcggcgcccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11765 - RNA, 9876 nt, synthetic construct
  misc_feature 1..9876: note = derived and/or modified CDS sequence (opt2) from DENV-2__FJ898449__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacctccgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaacaaccgccccggctaccacacccagaccgccggcccctggcacctcggcaagctcgagatggacttcgacttctgcgagggcaccaccgtcgtcgtcaccgaggagtgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagaagtacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaacccccgcaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgcctccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggccacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcgtcccccccgagcgctgcgacaccctcctctgcgacatcggcgagtcctcccccaaccccaccgtcgaggccggccgcaccctccgcgtcctcaacctcgtcgagaactggctcaacaacaacacccagttctgcgtcaaggtcctcaacccctacatgccctccgtcatcgagcgcatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgaggcctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcaccaagaaggtccgctccaacgccgccctcggcgccatcttcaccgacgagaacaagtggaagtccgcccgcgaggccgtcgaggacaaccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgcctccgaggagatcgccgtccaggactggctcgtccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaaccgcgtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11766 - RNA, 9876 nt, synthetic construct
  misc_feature 1..9876: note = derived and/or modified CDS sequence (opt2) from DENV-2__FJ906966__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggcctcaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgatcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggatcatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccagccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgccaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11767 - RNA, 9876 nt, synthetic construct
  misc_feature 1..9876: note = derived and/or modified CDS sequence (opt2) from DENV-2__FJ906968__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgatcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggatcatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccagccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacgaggtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcctcttccccgtctccatccccatcaccgccgccgcctggtgcctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11768 - RNA, 9876 nt, synthetic construct
  misc_feature 1..9876: note = derived and/or modified CDS sequence (opt2) from DENV-2__FJ906969__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggatcatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccagccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcctcttccccgtctccatccccatcaccgccgccgcctggtgcctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11769 - RNA, 9876 nt, synthetic construct
  misc_feature 1..9876: note = derived and/or modified CDS sequence (opt2) from DENV-2__FJ898454__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcctacgaggagggcatctgcggcatccgctccgtcacccgcctcgagaacctcatgtggaagcagatcacccccgagctcaaccacatcctctccgagaacgaggccaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaagaacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatcaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccaccctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagcgcgacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 11770 - RNA, 9876 nt, synthetic construct
  misc_feature 1..9876: note = derived and/or modified CDS sequence (opt2) from DENV-2__JQ922551__SS-prME
  source 1..9876: mol_type = other RNA
accgtcggcatgatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctcaagcagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctgcaagcacgcccagcgcatcgagacctggatcctccgccacccctccttcaccatcatggccgccatcctcgcctacaccatcggcaccacctacttccagcgcgtcgtcttcctcatggtcctcaccgccgtcgccctctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtccgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccctcgtcatcaccccccactccggcgaggagaacgccgtcggcaacgacaccggcaaccacggcaaggagatcaaggtcaccccccagtcctccatcaccgaggccgccctcaccggctacggcaccgtcaccatggagtgctccccccgcaccggcctcaacttccacgagatggtctccctccccatggagaacaaggcctggatggtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtctggggcatcgcccgcacccagcacggcaccatcgtccaccgcgtccagtacgagggcgacggctccccctgcaagatccccctcaacatcatgggcctcgagaagcgccacgtcctcggccgccccatcaccgtcaaccccatcgtcaccggcaaggactcccccgtcaacatcgaggccgagccccccctcggcgactcctacatcatcatcggcgtcgagcccggccaggtcaagctcacctgctcccagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgcccctccaccaaccgcgcctggaactccctcaagggcggcgactacggcttcggcgtcttcaccaccaacatctggctcaagctcaaggagcgccaggacgtctcctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccgagcacgagcagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccatgatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacctcctccccggccgctccgccgacctcgagctcgagcgcgccgccgacctccgctgggaggaccaggccgagatctccggctcctcccccatcctctccatcaccatctccgaggacggctccatgtccatcaagaaccaggaggagaagcagaccctcaccatcctcatcaagaccggcctcctcgtcatctccgagctcttccccgtccagatccccatcaccgccgccgcctggtacctctgggaggtcaagaagcagcgcgccggcgtcctctgggacgtcccctcccccccccccgtcggcaaggccgagctcgaggacggcgcctacggcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagacccgccccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagaagaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgccgtcgccgccaccatggccaacgagatgggcttcctcgagaagaccaagaaggacttcggcctcggctccatcgccacccagccccccgagtccaacatcctcgacatcgacctccgccccgcctccgcctggaccctctacgccgtcgccaccaccttcatcacctccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaagtccgacacccgcacccaggagcccaaggagggcaccaagaagctcatgaagatcacccccaagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatgggcgccaaccacctcgagggcgagcccaagaagctctacgaggccatcttcaagctcacctaccagaacaagggcgtccgcgtccagcgccccaccccccgcggccccctcatggacatcatcctccgccgcgaccagggcggctccggccaggtcggcacctacggcctcaacaccttcaccaacatgggcgcccagctcatccgccagatggagggcgagggcgtcttcaagggcatccagcacctcatcgccaccgaggagatcgccgtccaggactggctcgcccgcgtcggccgcgagcgcttctcccgcatggccatctccggcgacgactgcgtcgtcaagcccctcgacgaccgcttcgcctccgccctcaccgccctcaacgacatgggcaaggagcgcaaggtcctccagcagtgggagccctcccgcgagtggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtcccagatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11771 - RNA, 9876 nt, synthetic construct
  misc_feature 1..9876: note = derived and/or modified CDS sequence (opt2) from DENV-2__JQ922550__SS-prME
  source 1..9876: mol_type = other RNA
accgtcggcatgatcatcatgctcatccccaccgtcatggcctcccacctcaccacccgcaacggcggcccccacatgatcgtcatcggccagcagaagcgcaagacctccttcttcaagaccaagaagggccacgacatgtgcaccctcatggccatggccttcggcgagttctgcgagaacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatgaagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcaaggacctcgagaagcgccacgtcctcggccgcctcatcaccgtcaaccccatcgtcaccgagaaggactcccccgtcaacatcgaggccgagccccccctcggcgactcctacatcatcatcggcgtcgagcccggccagctcaagctcgactggttcaagaagggctcctccatcggccagatgttcgagaacaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcggcggctgcgagcgcaagaccaagaccaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggggcaacggcgtcctcgagtccgagatggtcatccccaagaacttcgccggccccgtctcccagcacaacaaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctccccccccccaagtaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctctcctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctccggcacctccaagcgccgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctccccccccctcgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccctcctcgagctcatccgcggcggccccatccccgtctacctcggctacaagtggcccggcgagggcatcaactacgccgactcccgcctctgcgtcggccgcacccagaacaaccagatcctcgaggagaacgtcgaggtcgagatctggaccaaggagggcaagggcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggcaacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcctcatccagatggccaacatcctccgcggctcctacctcgccggcgccggccccctcttctccatcatggagaacaccaccggcccccgccgccgcaccggccagctcggccgcgagctcctccgccgctggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagcgctgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcatccaggagcccaaggagggcaccaagaagctcatgaagatcatggccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcggcgccctcaagaacgagcgcaagtgcaccgagcacatggagggcgagccccgcaagcccggccgcggccacttcaagtggcgcaaccagaaccgcgtcgtcggcgtccagggccccacccccggcggcaccgtcatggacatcatctcccgcaagaaccagcgcggctccggccaggtcggcacctacggcctcaacaccttcaccaacatggaggcccagctcatccgccagatggagggcgagggcttcttcatcgagcaccagcacctcaccgcctccgaggagaacgccgtccaggactggctcgcccgcgtcggccgcgagaaggtctcccgcatgcccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccttcggcgagaccgcctgcctcggcaagtcctacgcccagatgtggtccctcatcaacttccgcatccccgacctccgcctcgccgccaacgtcatctgctccgtcgtcccctcccactgggtccccacctcccgcaccacctggtccatccacgccaaccacgagtggatgaccaccgaggacatgctcaccgtctggaaccgcgtctggatcctcgagaacccctggatggaggacaagacccccgtcgagtcctgggaggagatcccctacctcgagaagcgcgaggaccagtggtgcggctccctcatcggcctcaccccccagcccccctgggccaagaacatcgagaccgccatcaaccaggtccgctccctcatcggcaacgaggagtacatcgactacctcccctccatgaagcgcttccgcatcgaggaggaggagtccggcttcctctggtga

SEQ ID NO: 11772 - RNA, 9876 nt, synthetic construct
  misc_feature 1..9876: note = derived and/or modified CDS sequence (opt2) from DENV-2__JQ922553__SS-prME
  source 1..9876: mol_type = other RNA
accgccggcatgatcatcatgctcatccccaccgtcatggccttccacctcaccacccgcaacgtcgagccccccatgatcttctcccgccaggagaagggcaagtccttcctcttcaagaccaaggacggccacgacatgtgcaccttcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgtcctcatcttcatcctcctcaccggcgtcgccccctccatgcgcatgcgctgcatcggcatctccaaccgcgacttcgtcgagggcgtctccggcggctcctgggtcgacatcgtcctcgagcacggctcctgcgtcaccaccatggccaagaacaagcccaccctcgacctcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcgccatcgtcacctgcgccatgttcacctgcaagaagtccatgaagggcaagatcgtccagcccgagaacctcgagtacaccgtcgtcatcaccccccactccggcgaggagtacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttcaagaagggctcctccatcggccagatgctcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcaccctcgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagatgctctccaccgagctccacaaccagaccttcctcatcgacggccccgagaccgccgagtgccccaacgccaaccgcgcctggaactccctcgaggtcgaggactacggcttccgcaagtacaagaccaagatctggcccaccctcaaggagtggcgcaaggtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggggcaacggcgtccaggagtccgagatggtcatccccaagaacttcgccggccccgtctcccagcacaacaaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggccggctgctggtactggatggacatccgccccctcaaggagaaggagaagaacctcgtctcctccctcgtcaccgccggccacggccagatcgacaacttctccctccgcatcctcggcatggccctcttcctcgagaagatgctcatgacccgcctcggcaccaagcacgccatcctcctcgtcgccgtctccttcgtcaccctcatcacccgcaacatgtccttcaaggacctcggccgcgtcatggtcatggtcggcgccaccatgaccgacgacatgcgcatgggcgtcacctacctcgccctcctccccgccttcaaggtccgccccaccttcgccaccggcctcctcctccgcaagctcacctccaaggagctcatgatgaccaccatcggcatcgtcctcttctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggcgcgtctcctgcaccatcctcgccgtcgtctccgtctcccccctcttcctcacctcctcccgccagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatccagcagaagggcatcttcggctactcccagatcggcgccggcgtctacaaggagggcaccttccccaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggactaccccgaggtcgagatggacatcttccgcaagaagcgcctcaccatcatggacttccaccccggcgccggccgccagaagcgctacttccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagatcgtctggttcgtcccctccctcaagaccggcaagtacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccctcctcgagctcatccgcggcggccccatccccgtctacctcggctacaagtggcccggcgagggcatcaactacgccgactcccgcctctgcttcgacggcatcaagaacaaccagatcctcgaggagaacgtcgaggtcgagatctggaccaaggagggcgagcgcaaggagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcggcgccctcgcctccctcatggtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcaccgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggcaacatcgccacccagcagtcctgcaagaagatcctcgacatctacctcggccccgccctcccctggaagctctacgccggcggcaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaagcccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgacgagcgcaacctcgtcacccccgagggcaaggtcgtcgacctcggctgcggccgcggcggctggtccttcttctgcggcggcctcaagaacgtccgcgaggtcaaggccctcaccatcggcggccccggccacgaggagcccatcctcatgtccacctacggccgcaacctcgtccgctcccagtccggcgtcgtcgtcttccacaccccccccgagaagtgcgacacctccctccgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctggggctcccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcatcaagaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagcgcaagaccaaccacatgggcggcgagcaccgcaagctcgcccgcggcatcttcaagatgaacctcaccaacaaggtcgtccgcgtccagcgccccacccccggcggcaccctcatggacatcatctcccgcaagacccagcgcggctccgagcaggtcggcacctacggcctcaccaccctcaccaacctcgaggccccccccatccgccagatggagggcaagggcgtcttcaagggccaccagcaccgcaccgcctccgaggagaacgccgtccaggactggctcgcccgcgtcggcggcgagcgcctctcccgcctcgccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagttctacgcccagcgctggtccctcatgtacttccaccgccgcgacctccgcctcgcccccaacgccatctgctccgccgtccgcacccactgggtccccacctcccgcaagacctggcccatccacgcctcccacgactggatgaccaccgaggtcatgctcaccgtctggaacaagctctggttccaggagaacccctggatggaggacaagacccccgtcggcttctgggaggagatccccttcctcgagaagggcaaggaccagtggggcggctccctcatcggcctcacctcccgccccccctgggccaagaacttccagcccgccatcaaccaggtccgctccctcctctgcaacgaggagtccgccgacttcatgccctccatgaagcgcttccgccgcgaggaggaggaggccggcgtcctctggtga

SEQ ID NO: 11773 - RNA, 9876 nt, synthetic construct
  misc_feature 1..9876: note = derived and/or modified CDS sequence (opt2) from DENV-2__JQ922549__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgcccccggcgaccaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcctcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctcaccaagtactgcatcgaggccaagctcaccaacaccaccaccgcctcccgctgccccacccagggcgagccctccctcaacgaggagcagcacaagcgcttcgtctgcaagcactccatggtcgaccgcggctggggcaacggctgcggcctcttcggcaagggcggcatcgtcacctgcgccatgttcacctgcaagaagaacatgaagggcaagatcgtccagcccgagaacctcgagtacaccatcgtcgtcaccccccactccggcgaggagaacgccgtcggcaacgacaccggcaagcacggcaaggagatcaaggtccgcccccagtcctccatcaccgaggccgagctcaccggctacggcaccgtcaccatggagtgctccccccgcaccggcttcgccttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgcctcgtcctcggccgcctcatcaccgtcaaccccatcgtcaccgagaaggactcccccgtcaacatcgaggccgagccccccttcggcgactcctacatcatcatcggcgtcgagcccggccagctcaagccctcctggttcaagaagggctcctccatccgccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcaccaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcggcggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttccacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcgagggcgaggagggcgacctcgtccactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggccgcatgatcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcgagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagtacgaggaggaggagcccaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctcctcccagatcggcgcccgcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcaccgtctccctcgacttctcccccggcacctccgagtcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcccccgtcaacgtctccctcaccgccatcgccaaccaggccaccgtcctcatgggcctcggcaagggctggcccctctccaagatggacatcggcgtcccccccctcgccatcggctgctactcccaggtcaaccccatcaccctcaccgccgccctcctcctcctcgtcgcccactacgccatcatcggccccggcctccaggtcaaggccacccgcgaggcccagaagcgcgccgccgccggcatcatgaagaaccccaccgtcgacggcatcaccgtcatcgacctcgaccccatcccctacgaccccaagttcgagaagcagctcggccagatcatgctccgcgtcctctgcgtcacccaggtcctcatgatgcgcaccacctgggccctctgcgaggccctcaccctcgccaccggccccatctccaccctctgggagggcaaccccggccgcctcggcaacaccaccatcgccgtctccatggccaacatcttccgcggctcctacctcgccggcgccggcctcctcttctccatcatgaagaacaccaccaacacccgccgcggcacctccaacctcggcgagaccctcggcgagaagtggaagaaccgcctcaactccctcggcaagtccgagttccagatctacaagaagtccggcatccaggaggtcgaccgcaccctcgccaaggagggcatcaagaagggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgaggacgtcttcttcaccccccccgagaagtgcgacaccctcctctgcgacatcggcgagtcctcccccaaccccaccgtcgaggccggccgcaccctccgcgtcctcaacatggtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccctcgtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttctcccgcaaggtccgctccaacgccgccctcggcgccatcttcaccgacgagaacaagtggaagtccgcccgcgaggccgtcgaggacggccgcttctgggagctcgtcgacaaggagcgcatcctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggagatcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacccgctccatccacgcccgccaggagtggatgaccaccgaggtcatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 11774 - RNA, 9876 nt, synthetic construct
  misc_feature 1..9876: note = derived and/or modified CDS sequence (opt2) from DENV-2__JQ922552__SS-prME
  source 1..9876: mol_type = other RNA
accgccggcatgatcatcatgctcatccccaccgtcatggccttccacctcaccacccgcaacggcgagccccccatgatcgtctcccgccaggagaagggcaagtccctcctcttcaagaccgaggacggcgtcaacatgtgcgccctcatggccatggacctcggcgagcgctgcgaggacaccatcacctacaactgccccctcctcaaccagaacgagcccgaggacatcgactgctggtgcaactccacctccacctgggtcacctacggcacctgcaccaccaccggcgagctccgccgcgagaagatctccgtcgccctcgtcccccacgtcggcatgggcctcgagacccgcaccgagacctggatgtcctccgagggcgcctggaagcacgcccagcgcatcgagatctggatcctccgccaccccggcttcaccatcatggccgccatcctcgcctacaccatcggcacctcccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagatcatgaagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgctcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcaccggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacatgttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggtcggcaagcgctccctccgcccccagcccaccgagctccgctactcctggaagacctggggccagcccaagatgctctcccccgagctccaccaccagaccttcctcatcgacggccccgagaccgccgagtgccccaacaccaaccgcacctgggactccctcgaggtcgaggactacggcttcggcgtcttcaccaccaagatctggctccgcctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccatgggcgtcctcgagtccgagatggtcatccccaagaacttcgccggccccgtctcccagcacaaccaccgccccggcatccccacccagaccgccggcccctggcacctcggcaagctcgagatggacttcgacttctgcgagggcaccaccgtcgtcgtcaccgaggactgcggcaaccgcggcccctccctccgcacctccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccggccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccctcgtctccgtctcccccctcttcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggacgaccaggccgagatctccggctcctcccccatcctctccatcaccatctccgaggacggctccatgtccatcaagaacgaggaggaggagcagaccctcaccatcctcatccgcaccgagctcctcgtcatctccggcctcttccccatctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgccgcaagaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcggccccgccgagggcatcaactacgccgaccgccgctggtgcttcgacggcatcaagaactcccagttcctcgaggagaacgtcgaggtcgagatctggccctccggcggcgagcgcaaggagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggcaacatcgtcacccagcagcccgagtccaacatcctcgacatcgacctccgccccgcctccgcctggaccctctacgccgccgccaccaccttcatcacccccatgctccgccactccatcgagaactcctccgtcaacatgtccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcaagggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggctcctcccaggtctggccctccatcaacaacctcaagggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcccccgcgaggagttcaccaagaaggtccgctccaacgccgccctcggcgccatcttcaccgacgccaccaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtccgcaagaaggagggcggcgccatgtacgccgacgactccgccggctgggacacccgcatcaccctcgaggacctcaagaacgaggagcgcatcaccaaccacatggaggtcgagcacaagaagctcgccgtcggccacttcatcctcacctaccccaacaaggtcgtccgcgtccagcgccccacccccgtcggcaccgtcatggacatcatctcccgcaagtcccagcgcggctccggccaggtcggcacctacggcctcaacaccttcaccaacctcgagggcccccgcatccgccagatggagggcgaggagtccttcaagtcccaccagctccagaccgccaccgagcgcaacgccgtccaggactggctcgcccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtgggtcgccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11775 - RNA, 9876 nt, synthetic construct
  misc_feature 1..9876: note = derived and/or modified CDS sequence (opt2) from DENV-2__GU131896__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcctccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccgtcggcaaggccctccaccagatcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgaccgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11776 - RNA, 9876 nt, synthetic construct
  misc_feature 1..9876: note = derived and/or modified CDS sequence (opt2) from DENV-2__GU131897__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcatcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcatggacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11777 - RNA, 9876 nt, synthetic construct
  misc_feature 1..9876: note = derived and/or modified CDS sequence (opt2) from DENV-2__GQ868631__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaagggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgtcgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatggccaccatcggcatcgtcctcctctcccagtccaccatccccgagaccgtcctcgagctcaccgacgccctcgccctcggcatgatggccctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccatgcagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11778 - RNA, 9876 nt, synthetic construct
  misc_feature 1..9876: note = derived and/or modified CDS sequence (opt2) from DENV-2__GU131899__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccgtcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11779 - RNA, 9876 nt, synthetic construct
  misc_feature 1..9876: note = derived and/or modified CDS sequence (opt2) from DENV-2__GU131900__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaaggacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11780 - RNA, 9876 nt, synthetic construct
  misc_feature 1..9876: note = derived and/or modified CDS sequence (opt2) from DENV-2__GU131901__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11781 - RNA, 9876 nt, synthetic construct
  misc_feature 1..9876: note = derived and/or modified CDS sequence (opt2) from DENV-2__GU131902__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcgccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11782 - RNA, 9876 nt, synthetic construct
  misc_feature 1..9876: note = derived and/or modified CDS sequence (opt2) from DENV-2__GU131924__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcaagaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatcgtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11783 - RNA, 9876 nt, synthetic construct
  misc_feature 1..9876: note = derived and/or modified CDS sequence (opt2) from DENV-2__GQ868638__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcctccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccgtcggcaaggccctccaccagatcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgaccgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcgcccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttccgcaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11784 - RNA, 9876 nt, synthetic construct
  misc_feature 1..9876: note = derived and/or modified CDS sequence (opt2) from DENV-2__GU131927__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggcccgcaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccgtcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggccgccgctccctccgcccccagcccaccgagctcaagtactcctggaagacctggggcaaggccaagatgctctccaccgagtcctacaaccagaccttcctcatcgacggccccgagaccaccgagtgccccaacgccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagtccctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccaccgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacacctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccacccagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga
